US012806289B2

(12) United States Patent
von Maltzahn et al.

(10) Patent No.: US 12,806,289 B2
(45) Date of Patent: Nov. 24, 2026

(54) FUSOSOME COMPOSITIONS FOR T CELL DELIVERY

(71) Applicant: FLAGSHIP PIONEERING INNOVATIONS V, INC., Cambridge, MA (US)

(72) Inventors: Geoffrey A. von Maltzahn, Somerville, MA (US); Jacob Rosenblum Rubens, Cambridge, MA (US); Jagesh Vijaykumar Shah, Lexington, MA (US); Albert Ruzo Matias, Brookline, MA (US); Ferdinando Pucci, Portland, OR (US); John Miles Milwid, Denver, CO (US); Michael Travis Mee, Montreal (CA); Neal Francis Gordon, Brookline, MA (US)

(73) Assignee: FLAGSHIP PIONEERING INNOVATIONS V, INC., Cambridge, MA (US)

( * ) Notice: Subject to any disclaimer, the term of this patent is extended or adjusted under 35 U.S.C. 154(b) by 1424 days.

(21) Appl. No.: 17/293,802

(22) PCT Filed: Nov. 14, 2019

(86) PCT No.: PCT/US2019/061434
§ 371 (c)(1),
(2) Date: May 13, 2021

(87) PCT Pub. No.: WO2020/102503
PCT Pub. Date: May 22, 2020

(65) Prior Publication Data
US 2023/0043255 A1 Feb. 9, 2023

Related U.S. Application Data

(60) Provisional application No. 62/900,053, filed on Sep. 13, 2019, provisional application No. 62/767,320, filed on Nov. 14, 2018.

(51) Int. Cl.

| | |
|---|---|
| ***A61K 48/00*** | (2006.01) |
| ***A61K 9/1271*** | (2025.01) |
| ***A61K 47/69*** | (2017.01) |
| ***C12N 15/88*** | (2006.01) |

(52) U.S. Cl.
CPC ........ *A61K 48/0058* (2013.01); *A61K 9/1271* (2013.01); *A61K 47/6901* (2017.08); *A61K 48/0033* (2013.01); *C12N 15/88* (2013.01); *C12N 2800/80* (2013.01); *C12N 2810/6072* (2013.01); *C12N 2810/6081* (2013.01); *C12N 2830/008* (2013.01)

(58) Field of Classification Search
None
See application file for complete search history.

(56) References Cited

U.S. PATENT DOCUMENTS

| | | | |
|---|---|---|---|
| 4,623,620 | A | 11/1986 | Roos et al. |
| 5,994,136 | A | 11/1999 | Naldini et al. |
| 6,013,516 | A | 1/2000 | Verma et al. |
| 6,276,394 | B1 | 8/2001 | Smith et al. |
| 6,416,997 | B1 | 7/2002 | Mir-Shekari et al. |
| 6,682,907 | B1 | 1/2004 | Charneau et al. |
| 6,790,641 | B2 | 9/2004 | Schauber et al. |
| 6,896,881 | B1 | 5/2005 | Russell et al. |
| 7,094,398 | B1 | 8/2006 | Lieber et al. |
| 7,329,807 | B2 | 2/2008 | Vadrucci et al. |
| 8,697,439 | B2 | 4/2014 | Mangeot et al. |
| 9,050,269 | B2 | 6/2015 | Discher et al. |
| 9,486,539 | B2 | 11/2016 | Lee et al. |
| 9,695,446 | B2 | 7/2017 | Mangeot et al. |
| 10,040,830 | B2 | 8/2018 | Chatterjee et al. |
| 10,064,958 | B2 | 9/2018 | Lee et al. |
| 10,441,601 | B2 | 10/2019 | Zakharenko |
| 10,624,849 | B2 | 4/2020 | Leonard et al. |
| 11,185,555 | B2 | 11/2021 | Harrison |
| 11,407,812 | B2 | 8/2022 | Thomas et al. |
| 11,576,872 | B2 | 2/2023 | von Maltzahn et al. |
| 11,576,982 | B2 | 2/2023 | Lee et al. |
| 11,603,543 | B2 | 3/2023 | Scholz et al. |
| 11,608,509 | B2 | 3/2023 | Costa Fejoz et al. |
| 2002/0150556 | A1 | 10/2002 | Vile et al. |
| 2003/0072773 | A1 | 4/2003 | Wertz et al. |
| 2003/0207445 | A1 | 11/2003 | Schauber et al. |

(Continued)

FOREIGN PATENT DOCUMENTS

| | | | |
|---|---|---|---|
| EP | 0229866 | A1 | 7/1987 |
| EP | 1 115 879 | A1 | 7/2001 |

(Continued)

OTHER PUBLICATIONS

Gorelik et al. 2 Nature Reviews | Immunology 46-53 (Year: 2001).*
Field et al. 18 Genes and Immunity 59-66 (Year: 2017).*
Kaur et al. 193(8) The Journal of Immunology 3914-3924 (Year: 2014).*
Valastyan et al. 9(11) Cell Cycle 2124-2129 (Year: 2010).*
Jackson et al., "The novel mechanism of initiation of picornavirus RNA translation," Trends Biochem Sci. (1990) vol. 15, No. 12, pp. 477-483.
Chung et al., "Characterization of the chicken??-globin?insulator," PNAS (1997) vol. 94, No. 2, pp. 575-580.

(Continued)

*Primary Examiner* — Nancy J Leith
(74) *Attorney, Agent, or Firm* — K&L Gates LLP

(57) ABSTRACT

The present disclosure provides, at least in part, methods and compositions for in vivo fusosome delivery. In some embodiments, the fusosome comprises a combination of elements that promote specificity for target cells, e.g., one or more of a fusogen, a positive target cell-specific regulatory element, and a non-target cell-specific regulatory element. In some embodiments, the fusosome comprises one or more modifications that decrease an immune response against the fusosome.

43 Claims, 24 Drawing Sheets

Specification includes a Sequence Listing.

(56) References Cited

U.S. PATENT DOCUMENTS

| | | | |
|---|---|---|---|
| 2004/0009604 A1 | 1/2004 | Zhang et al. |
| 2004/0028687 A1 | 2/2004 | Waelti |
| 2005/0070493 A1 | 3/2005 | Fawell et al. |
| 2006/0045910 A1 | 3/2006 | Ehringer |
| 2006/0104950 A1 | 5/2006 | Okano et al. |
| 2007/0031455 A1 | 2/2007 | Audonnet |
| 2008/0269258 A1 | 10/2008 | Breaker et al. |
| 2009/0041724 A1 | 2/2009 | Jensen |
| 2009/0202622 A1 | 8/2009 | Fleury et al. |
| 2010/0316570 A1 | 12/2010 | Discher et al. |
| 2011/0184049 A1 | 7/2011 | Chuah et al. |
| 2012/0093885 A1 | 4/2012 | Sahoo et al. |
| 2012/0177574 A1 | 7/2012 | Gho et al. |
| 2012/0322147 A1 | 12/2012 | Mangeot et al. |
| 2013/0273549 A1 | 10/2013 | Sullivan et al. |
| 2013/0337066 A1 | 12/2013 | Zhang et al. |
| 2014/0079774 A1 | 3/2014 | Brinker et al. |
| 2014/0242107 A1 | 8/2014 | Mangeot et al. |
| 2015/0050242 A1 | 2/2015 | Lee et al. |
| 2015/0216903 A1 | 8/2015 | Heffner et al. |
| 2016/0011197 A1 | 1/2016 | Walfish et al. |
| 2016/0220700 A1 | 8/2016 | Harrison |
| 2016/0354313 A1 | 12/2016 | De Beer |
| 2017/0087087 A1 | 3/2017 | Leonard et al. |
| 2017/0112773 A1 | 4/2017 | Stachowiak et al. |
| 2017/0165348 A1 | 6/2017 | Cantore et al. |
| 2017/0183686 A1 | 6/2017 | Khvorova et al. |
| 2017/0189449 A1 | 7/2017 | Lim |
| 2017/0296677 A1 | 10/2017 | Lee et al. |
| 2018/0028600 A1 | 2/2018 | Hong et al. |
| 2018/0028687 A1 | 2/2018 | Selaru et al. |
| 2018/0312824 A1 | 11/2018 | Zhang et al. |
| 2018/0318331 A1 | 11/2018 | Zakharenko |
| 2019/0010210 A1 | 1/2019 | Thomas et al. |
| 2019/0125898 A1 | 5/2019 | Lee et al. |
| 2019/0144885 A1 | 5/2019 | Costa Fejoz et al. |
| 2019/0271006 A1 | 9/2019 | Nakaishi et al. |
| 2019/0351047 A1 | 11/2019 | Jasny et al. |
| 2020/0016189 A1 | 1/2020 | Zakharenko |
| 2020/0060980 A1 | 2/2020 | von Maltzahn et al. |
| 2020/0109419 A1 | 4/2020 | Scholz |
| 2020/0261589 A1 | 8/2020 | Galy et al. |
| 2021/0137839 A1 | 5/2021 | von Maltzahn et al. |
| 2021/0187018 A1 | 6/2021 | von Maltzahn et al. |
| 2021/0198698 A1 | 7/2021 | von Maltzahn et al. |
| 2021/0222197 A1 | 7/2021 | Cantore et al. |
| 2021/0228627 A1 | 7/2021 | von Maltzahn et al. |
| 2022/0008557 A1 | 1/2022 | von Maltzahn et al. |
| 2023/0043255 A1 | 2/2023 | von Maltzahn et al. |
| 2023/0048166 A1 | 2/2023 | von Maltzahn et al. |
| 2023/0068547 A1 | 3/2023 | von Maltzahn et al. |
| 2023/0285591 A1 | 9/2023 | Lee et al. |
| 2023/0348934 A1 | 11/2023 | Fejoz et al. |
| 2024/0033227 A1 | 2/2024 | von Maltzahn et al. |
| 2024/0279685 A1 | 8/2024 | Lee et al. |

FOREIGN PATENT DOCUMENTS

| | | | | |
|---|---|---|---|---|
| EP | 2615176 A1 | 7/2013 | | |
| JP | H10313865 A | 12/1998 | | |
| JP | 2013034401 A | 2/2013 | | |
| WO | 1992/08796 A1 | 5/1992 | | |
| WO | 1994006920 A1 | 3/1994 | | |
| WO | 1994/028143 A1 | 12/1994 | | |
| WO | 1995023846 A1 | 9/1995 | | |
| WO | 9532706 A1 | 12/1995 | | |
| WO | 1997004748 A2 | 2/1997 | | |
| WO | 1998/17815 A1 | 4/1998 | | |
| WO | 1999/15683 A1 | 4/1999 | | |
| WO | 1999/32646 A1 | 7/1999 | | |
| WO | 1999/41397 A1 | 8/1999 | | |
| WO | 2000009730 A2 | 2/2000 | | |
| WO | 2000017374 A1 | 3/2000 | | |
| WO | 2001/079518 A2 | 10/2001 | | |
| WO | 01075135 A1 | 10/2001 | | |
| WO | 2001074861 A2 | 10/2001 | | |
| WO | 2002002765 A2 | 1/2002 | | |
| WO | 2002044206 A2 | 6/2002 | | |
| WO | 2002088346 A2 | 11/2002 | | |
| WO | 2003/097797 A2 | 11/2003 | | |
| WO | 2004038029 A1 | 5/2004 | | |
| WO | 2006/028786 A2 | 3/2006 | | |
| WO | 2006027202 A1 | 3/2006 | | |
| WO | 2006/055351 A2 | 5/2006 | | |
| WO | 2006/059141 A2 | 6/2006 | | |
| WO | 2006/078221 A1 | 7/2006 | | |
| WO | 2007/000668 A2 | 1/2007 | | |
| WO | 2007005244 A1 | 1/2007 | | |
| WO | 2008/037458 A2 | 4/2008 | | |
| WO | 2008071959 A1 | 6/2008 | | |
| WO | 2008115199 A2 | 9/2008 | | |
| WO | 2009130208 A1 | 10/2009 | | |
| WO | 2010/053489 A1 | 5/2010 | | |
| WO | 2011011584 A1 | 1/2011 | | |
| WO | 2011/058052 A1 | 5/2011 | | |
| WO | 2012/04639 A1 | 1/2012 | | |
| WO | 2012079000 A1 | 6/2012 | | |
| WO | 2012/131419 A1 | 10/2012 | | |
| WO | 2012/149376 A2 | 11/2012 | | |
| WO | 2012/156839 A2 | 11/2012 | | |
| WO | 2012158643 A1 | 11/2012 | | |
| WO | 2012170911 A2 | 12/2012 | | |
| WO | 2013040557 A2 | 3/2013 | | |
| WO | 2013084000 A2 | 6/2013 | | |
| WO | 2013/148327 A1 | 10/2013 | | |
| WO | 2014/076137 A1 | 5/2014 | | |
| WO | 2015011478 A1 | 1/2015 | | |
| WO | 2015/110957 A2 | 7/2015 | | |
| WO | 2015161276 A2 | 10/2015 | | |
| WO | 2015/168613 A2 | 11/2015 | | |
| WO | 2016009326 A1 | 1/2016 | | |
| WO | 2016/020056 A1 | 2/2016 | | |
| WO | 2016/030414 A1 | 3/2016 | | |
| WO | 2016/126608 A1 | 8/2016 | | |
| WO | 2016/138525 A1 | 9/2016 | | |
| WO | 2016183482 A1 | 11/2016 | | |
| WO | 2016196350 A1 | 12/2016 | | |
| WO | 2017011519 A1 | 1/2017 | | |
| WO | 2017/058753 A1 | 4/2017 | | |
| WO | 2017/058850 A1 | 4/2017 | | |
| WO | 2017075540 A1 | 5/2017 | | |
| WO | 2017/143094 A1 | 8/2017 | | |
| WO | 2017151717 A1 | 9/2017 | | |
| WO | 2017165245 A2 | 9/2017 | | |
| WO | 2017/173034 A1 | 10/2017 | | |
| WO | 2017/182585 A1 | 10/2017 | | |
| WO | 2017173367 A2 | 10/2017 | | |
| WO | 2017/211945 A1 | 12/2017 | | |
| WO | 2017/218850 A1 | 12/2017 | | |
| WO | 2018009923 A1 | 1/2018 | | |
| WO | 2018/023094 A1 | 2/2018 | | |
| WO | 2018022749 A1 | 2/2018 | | |
| WO | 2018/127584 A1 | 7/2018 | | |
| WO | 2018/127585 A1 | 7/2018 | | |
| WO | WO-2018129563 A1 | * | 7/2018 | ......... A61K 48/0025 |
| WO | 2018208728 A1 | 11/2018 | | |
| WO | 2019077149 A1 | 4/2019 | | |
| WO | 2019/113512 A1 | 6/2019 | | |
| WO | 2019/152692 A1 | 8/2019 | | |
| WO | 2019/161281 A1 | 8/2019 | | |
| WO | 2019204666 A1 | 10/2019 | | |
| WO | 2019/222403 A2 | 11/2019 | | |
| WO | 2020/014209 A1 | 1/2020 | | |
| WO | 2020/102499 A2 | 5/2020 | | |
| WO | 2020/102503 A2 | 5/2020 | | |
| WO | 2020/102578 A1 | 5/2020 | | |
| WO | 2020102485 A1 | 5/2020 | | |
| WO | 2022010889 A1 | 1/2022 | | |

OTHER PUBLICATIONS

Chang et al., "Juxtacrine interaction of macrophages and bone marrow stromal cells induce interleukin-6 signals and promote cell migration," Bone Research (2015) vol. 3, Article No. 15014.

(56) References Cited

OTHER PUBLICATIONS

Bratosin et al., "Novel fluorescence assay using calcein-AM for the determination of human erythrocyte viability and aging," Cytometry A. (2005) vol. 66, No. 1, pp. 78-84.
Bender et al., "Developing an Engineered Nipah Virus Glycoprotein Based Lentiviral Vector System Retargeted to Cell Surface Receptors of Choice," Mol. Ther. (2015) vol. 23, No. 1, S2.
Barile et al, "Exosomes: Therapy delivery tools and biomarkers of diseases" Pharmacol Ther (2017) vol. 174, pp. 63-78.
Anliker et al., "Specific gene transfer to neurons, endothelial cells and hematopoietic progenitors with lentiviral vectors," Nat Methods. (2010) vol. 7, No. 11, pp. 929-935.
Zhou et al., "T-cell receptor gene transfer exclusively to human CD8+ cells enhances tumor cell killing," Blood (2012) vol. 120, No. 22, pp. 4334-4342.
Zakaria et al., "Combination of hepatocyte specific delivery and transformation dependent expression of shRNA inducing transcriptional gene silencing of c-Myc promoter in hepatocellular carcinoma cells", BMC Cancer, Biomed Central, London (2014) vol. 14, No. 1, pp. 582.
Yao et al., "Tetracycline repressor, tetR, rather than the tetR-mammalian cell transcription factor fusion derivatives, regulates inducible gene expression in mammalian cells," Hum Gene Ther. (1998) vol. 9, No. 13, pp. 1939-1950.
Yang et al., "Targeting lentiviral vectors to specific cell types in vivo," PNAS (2006) vol. 103, No. 31, pp. 11479-11484.
Verhoeyen et al., "IL-7 surface-engineered lentiviral vectors promote survival and efficient gene transfer in resting primary T lymphocytes," Blood (2013) vol. 101, No. 6, pp. 2167-2174.
Veillettte et al., "High expression of inhibitory receptor SHPS-1 and its association with protein-tyrosine phosphatase SHP-1 in macrophages," J Biol Chem. (1998) vol. 273, No. 35, pp. 22719-22728.
Tomas et al., "Improved GaLV-TR glycoproteins to pseudotype lentiviral vectors: impact of viral protease activity in the production of LV pseudotypes." Molecular Therapy (2019) vol. 15, pp. 1-8.
Schauber-Plewa et al., "Complement regulatory proteins are incorporated into lentiviral vectors and protect particles against complement inactivation." Gene Therapy. (2004) vol. 12, No. 3, pp. 238-245.
Pusch et al., "Community structure and feeding ecology of mesopelagic fishes in the slope waters of King George Island (South Shetland Islands, Antarctica)," Deep Sea Research Part I Oceanographic Research Papers (2004) vol. 51, No. 11, pp. 1685-1708.
Podbilewicz, "Virus and cell fusion mechanisms," Annu Rev Cell Dev Biol (2014) vol. 30, pp. 111-139.
Oldenborg et al., "Role of CD47 as a marker of self on red blood cells," Science. (2000) vol. 288, No. 5473, pp. 2051-2054.
Naldini et al., "Lentiviruses as gene transfer agents for delivery to non-dividing cells", Curr Opin Biotechnol., (1998); vol. 5, pp. 457-463.
Naldini et al., "In vivo gene delivery and stable transduction of nondividing cells by a lentiviral vector," Science (1996) vol. 272, No. 5259, pp. 263-267.
Nakamura et al., "Rescue and propagation of fully retargeted oncolytic measles viruses," Nat Biotechnol. (2005) vol. 23, No. 2, pp. 209-214.
Mullen et al., "Transfer of the bacterial gene for cytosine deaminase to mammalian cells confers lethal sensitivity to 5-fluorocytosine: a negative selection system," Proc Natl Acad Sci U S A. (1992) vol. 89, No. 1, pp. 33-37.
Montagna et al., "VSV-G-Enveloped Vesicles for Traceless Delivery of CRISPR-Cas9" Mol Ther Nucleic Acids. (2018) vol. 12, pp. 453-462.
Milani et al., "Genome editing for scalable produciton of alloantigen free lentiviral vectors for in vivo gene therapy." EMBO Molecular Medicine (2017) vol. 9, No. 11, pp. 1558-1573.
Mesner et al., "The matrix attachment region in the Chinese hamster dihydrofolate reductase origin of replication may be required for local chromatid separation," Proc Natl Acad Sci USA. (2003) vol. 100, No. 6, pp. 3281-3286.
Mckeague et al., "Opportunities in the design and application of RNA for gene expression control," Nucleic Acids Res. (2016) vol. 44, No. 7, pp. 2987-2999.
Martarano et al., "Equine Infectious Anemia Virus trans-Regulatory Protein Rev Controls Viral mRNA Stability, Accumulation, and Alternative Splicing," J. Virol. (1994) vol. 68, No. 5, pp. 3102-3111.
Mansfield et al., "MicroRNA-responsive 'sensor' transgenes uncover Hox-like and other developmentally regulated patterns of vertebrate microRNA expression," Nature Genetics (2004) vol. 36, pp. 1079-1083.
Mandal et al., "Riboswitches control fundamental biochemical pathways in Bacillus subtilis and other bacteria," Cell. (2003) vol. 113, No. 5, pp. 577-586.
Landau et al., :"Packaging system for rapid production of murine leukemia virus vectors with variable tropism," J Virol. (1992) vol. 66, No. 8, pp. 5110-5113.
Johnson et al., "Computer analysis of retroviral pol genes: assignment of enzymatic functions to specific sequences and homologies with nonviral enzymes," Proc Natl Acad Sci U S A. (1986) vol. 83, No. 20, pp. 7648-7652.
Haga et al.,"Permanent, lowered HLA class I expression using lentivirus vectors with shRNA constructs: averting cytotoxicity by alloreactive T lymphocytes." Transplantation Proceedings (2006) vol. 38, No. 10, pp. 3184-3188.
Funke et al., "Targeted cell entry of lentiviral vectors," Mol. Ther. (2008) vol. 16, No. 8, pp. 1427-1436.
Frecha et al., "Stable transduction of quiescent T cells without induction of cycle progression by a novel lentiviral vector pseudotyped with measles virus glycoproteins," Blood (2008) vol. 112, No. 13, pp. 4842-4852.
Frappier et al., "Autonomous replication of plasmids bearing monkey DNA origin-enriched sequences," Proc Natl Acad Sci U S A. (1987) vol. 84, No. 19, pp. 6668-6672.
Emery et al., "The use of chromatin insulators to improve the expression and safety of integrating gene transfer vectors," Hum Gene Ther. (2011) vol. 22, No. 6, pp. 761-774.
Calin et al., "Human microRNA genes are frequently located at fragile sites and genomic regions involved in cancers," Proc Natl Acad Sci U S A. (2004) vol. 101, No. 9, pp. 2999-3004.
Calin et al., "Frequent deletions and down-regulation of micro-RNA genes miR15 and miR16 at 13q14 in chronic lymphocytic leukemia," Proc Natl Acad Sci U S A. (2002) vol. 99, No. 24, pp. 15524-15529.
Araujo et al., "Identification of initiation sites for DNA replication in the human dnmt1 (DNA-methyltransferase) locus," J Biol Chem. (1999) vol. 274, No. 14, pp. 9335-9341.
Chen et al., "MicroRNAs as regulators of mammalian hematopoiesis," Semin Immunol. 2005 vol. 17, No. 2, pp. 155-165.
Ejsing et al. (2009). Global analysis of the yeast lipidome by quantitative shotgun mass spectrometry. PNAS vol. 106, No. 7, pp. 2136-2141.
Enkirch et al., "Targeted lentiviral vectors pseudotyped with the Tupaia paramyxovirus glycoproteins," Gene Ther. (2013) vol. 20, pp. 16-23.
Dull et al., "A third-generation lentivirus vector with a conditional packaging system," J. Virol. (1998) vol. 72, No. 11, pp. 8463-8471.
Du et al., "microPrimer: the biogenesis and function of microRNA," Development. (2005) vol. 132, No. 21, pp. 4645-4652.
Gabriel et al., "Comprehensive genomic access to vector integration in clinical gene therapy," Nat Med. (2009) vol. 15, No. 12, pp. 1431-1436.
Cullen et al., "Human immunodeficiency virus as a prototypic complex retrovirus.," J Virol. (1991), vol. 65, No. 3, pp. 1053-1056.
Clever et al., "RNA secondary structure and binding sites for gag gene products in the 5' packaging signal of human Immunodeficiency virus type 1," J Virol. (1995) vol. 69, No. 4, pp. 2101-2109.
Houbaviy et al., "Embryonic stem cell-specific MicroRNAs," Dev Cell. (2003) vol. 5, No. 2, pp. 351-358.

(56) References Cited

OTHER PUBLICATIONS

Irion et al., "Identification and targeting of the ROSA26 locus in human embryonic stem cells," Nat Biotechnol. (2007), vol. 25, No. 12, pp. 1477-1482.
Jackson et al., "Internal initiation of translation in eukaryotes: the picornavirus paradigm and beyond," RNA. (1995) vol. 1, No. 10, pp. 985-1000.
Raffin et al., "Development of citrullinated-vimentin-specific CAR for targeting Tregs to treat autoimmune rheumatoid arthritis," J Immunol (2016) vol. 196, Supp 1, No. 210, pp. 19.
Crop et al., "Human mesenchymal stem cells are susceptible to lysis by CD8+ T cells and NK cells," Cell Transplantation (2011) 20:1547-1559.
Sha et al., "Chimaeric antigen receptor T-cell therapy for tumour immunotherapy," Biosci Rep (2017) vol. 37, No. 1, BSR20160332.
Elinav et al. "Amelioration of colitis by genetically engineered murine regulatory T cells redirected by antigen-specific chimeric receptor." Gastroenterology 136.5 (2009): pp. 1721-1731.
Cullen et al., "Regulatory pathways governing HIV-1 replication," Cell. (1989) 58(3):423-426.
Boardman et al. "Expression of a chimeric antigen receptor specific for donor HLA class I enhances the potency of human regulatory T cells in preventing human skin transplant rejection." American Journal of Transplantation (2017), vol. 17, No. 4, pp. 931-943.
Yanez-Munoz et al., "Effective gene therapy with nonintegrating lentiviral vectors," Nat Med. (2006) vol. 12, No. 3, pp. 348-353.
Garst et al., "Riboswitches: Structures and Mechanisms," Cold Spring Harb Perspect Biol. (2011) vol. 3, No. a003533.
Noyan et al. "Prevention of allograft rejection by use of regulatory T cells with an MHC?specific chimeric antigen receptor." American Journal of Transplantation (2017) vol. 17, No. 4, pp. 917-930.
Zhang et al., "Engineering CAR-T cells," Biomarker Research (2017) vol. 5, article No. 22.
Yoon et al. "FVIII-specific human chimeric antigen receptor T-regulatory cells suppress T-and B-cell responses to FVIII." Blood, the Journal of the American Society of Hematology (2017) vol. 129, No. 2, pp. 238-245.
Swerdlow et al., "Bcl-2-regulated calcium signals as common mediators of both apoptosis and autophagy." Developmental cell (2007) vol. 12, No. 2, pp. 178-179.
Schmidt et al. "The enhancer and promoter landscape of human regulatory and conventional T-cell subpopulations." Blood, the Journal of the American Society of Hematology (2014) vol. 123, pp. 17, e68-e78.
Fransonn et al. "CAR/FoxP3-engineered T regulatory cells target the CNS and suppress EAE upon intranasal delivery" Journal of neuroinflammation 9.1 (2012) pp. 1-12.
Koreth et al. "Efficacy, durability, and response predictors of low-dose interleukin-2 therapy for chronic graft-versus-host disease." Blood, the Journal of the American Society of Hematology (2016) vol. 128, No. 1, pp. 130-137.
Kennedy-Nasser et al. "Ultra low-dose IL-2 for GVHD prophylaxis after allogeneic hematopoietic stem cell transplantation mediates expansion of regulatory T cells without diminishing antiviral and antileukemic activity." Clinical Cancer Research (2014) vol. 20, No. 8, pp. 2215-2225.
Mekala et al,. "Immunotherapy of autoimmune encephalomyelitis with redirected CD4+ CD25+ T lymphocytes." Blood (2005) vol. 105, No. 5, pp. 2090-2092.
Calvo et al. (2015). MitoCarta2.0: an updated inventory of mammalian mitochondrial proteins. Nucleic Acids Res. vol. 44, No. D1, pp. D1251-D1257.
Imamura et al., Autonomous growth and increased cytotoxicity of natural killer cells expressing membrane-bound interleukin-15, Blood (2014) vol. 124, No. 7, pp. 1081-1088 (Aug. 2014).
Matsuoka et al., "Low-dose interleukin-2 therapy restores regulatory T cell homeostasis in patients with chronic graft-versus-host disease," Sci Transl Med (2013) vol. 5, No. 179, 179ra43.
Blat et al. "Suppression of murine colitis and its associated cancer by carcinoembryonic antigen-specific regulatory T cells." Molecular Therapy (2014) vol. 22, No. 5, pp. 1018-1028.
Becker et al. "In vivo imaging of colitis and colon cancer development in mice using high resolution chromoendoscopy." Gut 54.7 (2005), pp. 950-954.
Macdonald et al. "Alloantigen-specific regulatory T cells generated with a chimeric antigen receptor." The Journal of clinical investigation (2016) vol. 126, No. 4, pp. 1413-1424.
Zhang et al. "Targeting FVIII-specific B cells using BAR-transduced regulatory T cells." Blood (2016) vol. 128, No. 22, pp. 329.
Griffiths-Jones et al., "miRBase: microRNA sequences, targets and gene nomenclature," Nucleic Acids Res. (2006) vol. 34(Database issue), pp. D140-D144.
Pierini et al. "T cells expressing chimeric antigen receptor promote immune tolerance." JCI insight (2017) vol. 2, No. 20.
Vlieghe et al. "Synthetic therapeutic peptides: science and market." Drug Discov. Today (2010) vol. 15, pp. 40-56.
Smigielska-Czepiel et al. "Comprehensive analysis of miRNA expression in T-cell subsets of rheumatoid arthritis patients reveals defined signatures of naive and memory Tregs." Genes & Immunity (2014) vol. 15, No. 2, pp. 115-125.
Field et al.,"Comparison of lentiviral and sleeping beauty mediated alpha&bgr T cell receptor gene transfer." PLOS ONE (2013) 8(6): e68201.
Ellebrecht et al. "Reengineering chimeric antigen receptor T cells for targeted therapy of autoimmune disease." Science (2016) vol. 353, No. 6295, pp. 179-184.
Smith et al., "In situ programming of leukaemia-specific T cells using synthetic DNA nanocarriers," Nature Nanotechnology (2017) vol. 12, pp. 813-820.
Gasteiger et al., "Protein Identification and Analysis Tools on the ExPASy Server," The Proteomics Protocols Handbook (2005) pp. 571-607.
Wittings et al., "Characterization of a third generation lentiviral vector pseudotyped with Nipah virus envelope proteins for endothelial cell transduction." Gene therapy (2013) vol. 20, No. 10, pp. 997-1005.
White et al., "Structures and mechanisms of viral membrane fusion proteins: multiple variations on a common theme," Crit Rev Biochem Mol Biol. (2008) vol. 43, No. 3, pp. 189-219.
Sun, W., "Henipavirus Assembly and Budding," Doctoral Dissertation (online). Pennsylvania 4-6, 7/4-6, 8/4-6 State University. 2015 [retrieved on Sep. 30, 2021]. Retrieved from the Internet: [URL:https://etda.libraries.psu.edu/files/final_submissions/10659]; abstract.
Sugimoto et al., "A novel human endogenous retroviral protein inhibits cell-cell fusion," Sci Rep (2013) vol. 3, pp. 1462.
Steffen et al., "Henipavirus mediated membrane fusion, virus entry and targeted therapeutics," Viruses (2012) vol. 4, pp. 280-309.
Sosale et al., "Marker of self: CD47 on lentiviral vectors decreases macrophage-mediated clearance and increases delivery to SIRPA-expressing lung carcinoma tumors." Molecular Therapy (2016) vol. 3, No. 7, pp. 16080.
Singh et al., "Mathematical model to predict regions of chromatin attachment to the nuclear matrix," Nucleic Acids Res. (1997) vol. 25, No. 7, pp. 1419-1425.
Sharei et al. (2013). A vector-free microfluidic platform for intracellular delivery. PNAS vol. 110, No. 6, pp. 2082-2087.
Riazifar et al., "Stem Cell Extracellular Vesicles: Extended Messages of Regeneration," Annu Rev Pharmacol Toxicol. (2017) vol. 57, pp. 125-154.
Quiros et al. (2015) New roles for mitochondrial proteases in health, ageing and disease. Nat. Rev. Mol. Cell Biol. vol. 16, No. 6, pp. 345-359.
Pager et al., "A mature and fusogenic form of the Nipah virus fusion protein requires proteolytic processing by cathepsin L," Virology. (2006) vol. 346, No. 2, pp. 251-257.
Negrete et al., "Single Amino Acid Changes in the Nipah and Hendra Virus Attachment Glycoproteins Distinguish EphrinB2 from EphrinB3 Usage," J Virol (2007) vol. 81, No. 19, pp. 10804-10814.

(56) References Cited

OTHER PUBLICATIONS

Naldini et al., Efficient transfer, integration, and sustained long-term expression of the transgene in adult rat brains injected with a lentiviral vector, Proc Natl Acad Sci U S A. (1996) vol. 93, No. 21, pp. 11382-11388.
Moll et al., "Importance of the cytoplasmic tails of the measles virus glycoproteins for fusogenic activity and the generation of recombinant measles viruses," J Virol. (2002) vol. 76, No. 14, pp. 7174-7186.
Maury et al., "Cellular and Viral Specificity of Equine Infectious Anemia Virus Tat Transactivation," Virology. (1994) vol. 200, pp. 632-642.
Mallilankaraman et al., "Visualization of vascular Ca2+ signaling triggered by paracrine derived ROS," J Vis Exp (2011) vol. 58, pp. 3511.
Lee et al., "Modes of paramyxovirus fusion: a Henipavirus perspective," Trends in Microbiology (2011) vol. 19, No. 8, pp. 389-399.
Lattanzi et al "A Strategy of antigen incoperation into exosomes: Comparing cross-presentation levels of antigens delivered by engineered exosomes and by lentiviral virus-like particles", Vaccine (2012) vol. 20, No. 50, p. 7229.
Jiang et al., "Integrin-associated protein is a ligand for the P84 neural adhesion molecule," J Biol Chem. (1999) vol. 274, No. 2, pp. 559-562.
Jones et al., "Optimization of tetracycline-responsive recombinant protein production and effect on cell growth and ER stress in mammalian cells," Biotechnology Bioengineering (2005) vol. 91, No. 6, pp. 722-732.
Kasashima et al., "Altered expression profiles of microRNAs during TPA-induced differentiation of HL-60 cells," Biochem Biophys Res Commun. (2004) vol. 322, No. 2, pp. 403-410.
Khan et al., "Retroviral integrase domains: DNA binding and the recognition of LTR sequences.," Nucleic Acids Res. (1991) vol. 19, No. 4, pp. 851-860.
Kim et al., "Guanine riboswitch variants from Mesoplasma florum selectively recognize 2?-deoxyguanosine," PNAS (2007) vol. 104, No. 41, pp. 16092-16097.
Kozak, "Point mutations define a sequence flanking the AUG initiator codon that modulates translation by eukaryotic ribosomes," Cell. (1986) vol. 44, No. 2, pp. 283-292.
Kramer et al., "Computer-assisted search for sites of nuclear matrix attachment," Genomics. (1996) vol. 33, No. 2, pp. 305-308.
Krichevsky et al., "A microRNA array reveals extensive regulation of microRNAs during brain development," RNA. (2003) vol. 9, No. 10, pp. 1274-1281.
Krutzfeldt et al., "Silencing of microRNAs in vivo with 'antagomirs'," Nature (2005) vol. 438, pp. 685-689.
Lagos-Quintana et al., "Identification of tissue-specific microRNAs from mouse," Curr Biol. (2002) vol. 12, No. 9, pp. 735-739.
Landy et al., "Mechanistic and structural complexity in the site-specific recombination pathways of Int and FLP," Current Opinion in Biotechnology (1993) vol. 3, pp. 699-707.
Chen et al., "MicroRNAs modulate hematopoietic lineage differentiation," Science. (2004) vol. 303, No. 5654, pp. 83-86.
Chen, "MicroRNAs as oncogenes and tumor suppressors," N Engl J Med. (2005), vol. 353, No. 17, pp. 1768-1771.
Liebisch et al., "High throughput quantification of cholesterol and cholesteryl ester by electrospray ionization tandem mass spectrometry (ESI-MS/MS)," Biochim Biophy Acta (BBA) Mol Cell Biol Lipids (2006) vol. 176, No. 1, pp. 121-128.
Lin et al "Incorporation of VSV-G produces fusogenic plasma membrane vesicles capable of efficient transfer of bioactive macromolecules and mitochondria" Biomed Microdevices (2016) vol. 18, No. 3, pp. 41.
Liu et al., "HnRNP L binds a cis-acting RNA sequence element that enables intron-dependent gene expression," Genes & Development (1995) vol. 9, No. 14, pp. 1766-1780.
Lupton et al., "Dominant positive and negative selection using a hygromycin phosphotransferase-thymidine kinase fusion gene," Mol and Cell Biol (1991) vol. 11, No. 6, pp. 3374-3378.
Mouro-Chanteloup et al., "Evidence that the red cell skeleton protein 4.2 interacts with the Rh membrane complex member CD47," Blood (2003) vol. 101, No. 1, pp. 338-344.
Challita et al., "Multiple modifications in cis elements of the long terminal repeat of retroviral vectors lead to increased expression and decreased DNA methylation in embryonic carcinoma cells," J Virol. (1995) vol. 69 No. 2, pp. 748-755.
Mcdevitt et al., "Discovering the role of the major histocompatibility complex in the immune response," Annu Rev Immunol. (2000) vol. 18, pp. 1-17.
Mcwhinney et al., "Autonomous replication of a DNA fragment containing the chromosomal replication origin of the human c-myc gene," Nucleic Acids Res. (1990) vol. 18, No. 5, pp. 1233-1242.
Cesana et al., "Uncovering and dissecting the genotoxicity of self-inactivating lentiviral vectors in vivo," Mol Ther. (2014) vol. 22, No. 4, pp. 774-785.
Metzler et al., "High expression of precursor microRNA-155/BIC RNA in children with Burkitt lymphoma," Genes Chromosomes Cancer. (2004) vol. 39, No. 2, pp. 167-169.
Michael et al., "Reduced accumulation of specific microRNAs in colorectal neoplasia," Mol Cancer Res. (2003) vol. 1. No. 12, pp. 882-891.
Millay et al., "Myomaker is a membrane activator of myoblast fusion and muscle formation," Nature (2013) vol. 499, pp. 301-305.
Morizono et al., "Antibody-directed targeting of retroviral vectors via cell surface antigens," J Virol. (2001) vol. 75, No. 17, pp. 8016-8020.
Munch et al., "DARPins: an efficient targeting domain for lentiviral vectors," Mol Ther. (2011) vol. 19, No. 4, pp. 686-693.
Burger et al., "Feline Leukemia Virus: Purification From Tissue Culture Fluids," J Natl Cancer Inst. (1970) vol. 45, No. 3, pp. 499-506.
Brown et al., "Endogenous microRNA regulation suppresses transgene expression in hematopoietic lineages and enables stable gene transfer," Nat. Med. (2006) vol. 12, No. 5, pp. 585-591.
Price et al., "Identification of a cis-Element That Determines Autonomous DNA Replication in Eukaryotic Cells," J Biol Chem. (2003) vol. 278, No. 22, pp. 19649-19659.
Rabinovitch, "Professional and non-professional phagocytes: an introduction," Trends Cell Biol. (1995) vol. 5, No. 3, pp. 85-87.
Bokhoven et al., "Insertional gene activation by lentiviral and gammaretroviral vectors," J Virol. (2009) vol. 83, No. 1, pp. 283-294.
Ramezani et al., "Performance- and safety-enhanced lentiviral vectors containing the human interferon-? scaffold attachment region and the chicken ?-globin insulator," Blood (2003) vol. 101, No. 12, pp. 4717-4724.
Bode et al., "Correlations between scaffold/matrix attachment region (S/MAR) binding activity and DNA duplex destabilization energy," J Mol Biol. (2006) vol. 358, No. 2, pp. 597-613.
Riedel et al., "Cell surface expression of fusogenic vesicular stomatitis virus G protein from cloned cDNA," EMBO J (1984) vol. 3, No. 7, pp. 1477-1483.
Sanges et al., "Reprogramming Muller glia via in vivo cell fusion regenerates murine photoreceptors," J Clin Invest (2016) vol. 126, No. (8), pp. 3104-3116.
Saphire et al., "Proteomic Analysis of Human Immunodeficiency Virus Using Liquid Chromatography/Tandem Mass Spectrometry Effectively Distinguishes Specific Incorporated Host Proteins," J Proteome Res (2006) vol. 5, No. 3, pp. 530-538.
Bode et al., "Biological significance of unwinding capability of nuclear matrix-associating DNAs," Science (1992) vol. 255, No. 5041, pp. 195-197.
Silverstein, "Phagocytosis of microbes: insights and prospects," Trends Cell Biol. (1995) vol. 5, No. 3, pp. 141-142.
Sirin et al., Regulating gene expression using self-inactivating lentiviral vectors containing the mifepristone-inducible system, Gene. (2003) vol. 323, pp. 67-77.

(56) References Cited

OTHER PUBLICATIONS

Soneoka et al., "A transient three-plasmid expression system for the production of high titer retroviral vectors," Nucleic Acids Res. (1995) vol. 23, No. 4, pp. 628-633.
Sood et al., "Cell-type-specific signatures of microRNAs on target mRNA expression," Proc Natl Acad Sci U S A. (2006) vol. 103, No. 8, pp. 2746-2751.
Bi et al., "WebSIDD: server for predicting stress-induced duplex destabilized (SIDD) sites in superhelical DNA," Bioinformatics. (2004) vol. 20, No. 9, pp. 1477-1479.
Swanson et al., "Phagocytosis by zippers and triggers," Trends Cell Biol. (1995) vol. 5, No. 3, pp. 89-93.
Tanaka et al., "Sendai virus-mediated gene transfer of the c-myc suppressor far-upstream element-binding protein-interacting repressor suppresses head and neck cancer," Gene Therapy (2015) vol. 22, pp. 297-304.
Thiam et al., Nature Reviews Molecular Cell Biology (2013)vol. 14, No. 12, pp. 775-785.
Toplin, "Purification of the Moloney and Rauscher Murine Leukemia Viruses by Use of Zonal Ultracentrifuge Systems," Appl Microbiol. (1967) vol. 15, No. 3, pp. 582-589.
Tsai et al, "Encapsulation of active cytoskeletal protein networks in cell-sized liposomes" Langmuir (2011) vol. 27, No. 16, pp. 10061-10071.
Bell et al., "The protein CTCF is required for the enhancer blocking activity of vertebrate insulators," Cell (1999) vol. 98, No. 3, pp. 387-396.
Barad et al., "MicroRNA expression detected by oligonucleotide microarrays: system establishment and expression profiling in human tissues," Genome Res. (2004) vol. 14, No. 12, pp. 2486-2494.
Abengozar et al., "Blocking ephrinB2 with highly specific antibodies inhibits angiogenesis, lymphangiogenesis, and tumor growth," Blood (2012) 119(19):4565-4576.
Agrawal et al., "Complement Evasion Strategies of Viruses: An Overview," Front Microbiol. Jun. 16, 2017;8:1117.
Aguilar et al., "N-Glycans on Nipah Virus Fusion Protein Protect against Neutralization but Reduce Membrane Fusion and Viral Entry," J Virol (2006) 80(10):4878-4889.
Aguilar et al., "Polybasic KKR Motif in the Cytoplasmic Tail of Nipah Virus Fusion Protein Modulates Membrane Fusion by Inside-Out Signaling," J Virol (2007) 81(9):4520-4532.
Akbulut, H. et al., Gene Therapy—Principles and Challenges, Hashad D. (Ed.), London, United Kingdom, IntechOpen, Nov. 26, 2015, Chapter 1: Cancer Gene Therapy: Section 6.3, 36 pages, retrieved from intechopen.com/books/4754 doi: 10.5772/59824.
Alam et al., "Coexpression of EphB4 and ephrinB2 in tumor advancement of uterine cervical cancers," Gynecologic Oncology (2009) 114(1):84-88.
Ali et al., "Virosome: An engineered virus for vaccine delivery," Saudi Pharmaceuticals Journal (2023), vol. 31, p. 752-764.
Bagai et al., "Targeted Delivery of Hygromycin B Using Reconstituted Sendai Viral Envelopes Lacking Hemagglutinin-neuraminidase," FEBS (1993), vol. 277, p. 183-188.
Batrakova et al., "Using exosomes, naturally-equipped nanocarriers, for drug delivery," J Control Release (2015) 219:396-405.
Bender et al., "Receptor-Targeted Nipah Virus Glycoproteins Improve Cell-Type Selective Gene Delivery and Reveal a Preference for Membrane-Proximal Cell Attachment," PLOS Pathogens (2016) 12(6):e1005641.
Biering et al. "N-glycans on the nipah virus attachment glycoprotein modulate fusion and viral entry as they protect against antibody neutrilization" Journal of Virology (2012) 86(22):11991-12002.
Blechacz et al. (Jun. 2008), "Measles Virus as an Oncolytic Vector Platform," Current Gene Therapy, 8(3), 162-175.
Brown et al., "A microRNA-regulated lentiviral vector mediates stable correction of hemophilia B mice," Blood. (2007) 110(13): 4144-4152.
Carter et al., "Versatile in vivo genome editing with the prototypical *Streptococcus thermophilus* CRISPR1-Cas9 system," BioRxiv. (2018); 10 pages.
Cattaneo, "Paramyxovirus entry and targeted vectors for cancer therapy," PLoS Pathog. (2010) 6(6):e1000973.
David et al., "Viral Vectors: The Road to Reducing Genotoxicity," Toxicol Sci. (2017) 155(2):315-325.
Dudu et al., "Sendai virus-based liposomes enable targeted cytosolic delivery of nanoparticles in brain tumor-derived cells," J Nanobiotechnology. (2012) 10:9.
Escors et al., "Cell and Tissue Gene Targeting with Lentiviral Vectors," Lentiviral Vectors and Gene Therapy. (2012) 29-50.
Ezigbo et al. (Sep. 30, 2014), "Hepatocellular carcinoma in a patient with chronic lymphocytic leukaemia involving the liver," BMJ Case Report, 1-3.
Fang et al., "Cell membrane-derived nanomaterials for biomedical applications," Biomaterials. (2017) 128: 69-83.
Felt et al., "Recent Advances in Vesicular Stomatitis Virus-Based Oncolytuc Virotherapy: a 5-year Update," Journal of General Virology (2017), vol. 98, p. 2895-2911.
Galimi et al., "Development of Ecdysone-Regulated Lentiviral Vectors," Molecular Therapy (2005) 11(1):142-148.
Girard Gagnepain (Nov. 11, 2014), "Evaluation of new lentiviral vector pseudotypes for gene transfer into hematopoietic cells," Virology, Ecole normale supérieure de lyon-Enslyon, NNT: 2014ENSL0939. tel-01084864, in 393 pages.
Gonzales-Aseguinolaza et al. (Sep. 2010), "Durable Correction of Inherited Metabolic Liver Disorders Requires Preventing Transgene Off-Targeting From Gene Therapy Vectors: The Value of MicroRNAs," Gastroenterology, 139(3), in 4 pages.
Greenberg et al., "Targeted transgene expression in Müller glia of normal and diseased retinas using lentiviral vectors," IOVS (2007) 48(4):1844-1852.
Hafid et al., "Phenylketonuria: a review of current and future treatments," Transl Pediatr. (2015) (4):304-17.
Juzenas et al., "A comprehensive, cell specific microRNA catalogue of human peripheral blood," Nucleic Acids Research (2017), vol. 45 (16), p. 9290-9301.
Kells et al., "Efficient gene therapy-based method for the delivery of therapeutics to primate cortex". PNAS (106):2407-2411, 2009.
Khetawat et a., "A Functional Henipavirus Envelope Glycoprotein Pseudotyped Lentivirus Assay System," Virol. J. (2010) 7:312.
Lam et al., "Efficient and Safe Herpes Simplex Virus Type 1 Amplicon Vector for Transpictionally Targeted Therapy for Human Hepatocellular Carcinomas," The American Society of Gene Therapy (2007), vol. 15, No. 6, p. 1129-1136.
Leavitt et al., "Concordant modulation of neutrilization resistance and high infectivity of the primary human immunodeficiency virus type 1 MN strain and definition of a potential gp41 binding site in gp120". Journal of Virology 560-570, 2003.
Lee et al., "Efficient gene transfer of VSV-G pseudotyped retroviral vector to human brain tumor," Gene Ther. (2001) 8 (4):268-73.
Lentz et al. "Review, viral vectors for gene delivery to the central nervous system" Neurobiology of Disease 48:179-188, 2012.
Levy et al. (Oct. 24, 2017), "Measles virus envelope pseudotyped lentiviral vectors transduce quiescent human HSCs at an efficiency without precedent," Blood Advances, 1(23), in 17 pages.
Li et al., "Enhancing HSP70-ShRNA Transfection in 22RV1 Prostate Cancer Cells by Combination of Sonoporation, Liposomes and HTERTA-CMV Chimeric Promoter," International Journal of Oncology (2013), vol. 43, p. 151-158.
LibreTexts. "4.4: Studying Cells—Cell Size." https://bio.libretexts.org/@go/page/12711 accessed Mar. 15, 2023, 2 pages.
Miao et al., "Inclusion of the hepatic locus control region, an intron, and untranslated region increases and stabilizes hepatic factor IX gene expression in vivo but not in vitro," Mol Ther. (2000) 1(6):522-32.
Morizono et al., "Redirecting lentiviral vectors pseudotyped with sinbis virus-derived envelope proteins to DC-Sign by modificiation of N-linked glycans of envelope proteins" J Virol. (2010) 84(14): 6923-34.
Nakamura et al., "Oncolytic Measles Viruses for Cancer Therapy," Expert Opinion on Biological Therapy (2004), vol. 4, No. 10, p. 1685-1692.
Nakamura et al., "Antibody-targeted cell fusion," Nat. Biotechnol. (2004) 22(3):331-6.

(56) References Cited

OTHER PUBLICATIONS

Negrete et al., "EphrinB2 is the entry receptor for Nipah virus, an emergent deadly paramyxovirus," Nature (2005) 436(7049):401-405.
Organism—Wikipedia p. 1 of 10 downloaded Nov. 6, 2017, Cited as: Organism—Wikipedia. Retrieved on Sep. 14, 2023. 7 pages.
Palomares et al., "Nipah virus envelope-pseudotyped lentiviruses efficiently target ephrinB2-positive stem cell populations in vitro and bypass the liver sink when administered in vivo," J Virol. (2013) 87(4): 2094-108.
Rockx et al. (Aug. 2012), "Recent progress in henipavirus research: molecular biology, genetic diversity, animal models," Antiviral Research, 95(2), 135-149.
Schneider et al., "A Tandem CD19/CD20 Lentiviral Vector Drives On-Target and Off-Target Antigen Modulation in Leukemia Cell Lines," Journal of Immunotherapy (2017), vol. 98, p. 2895-2911.
Shim et al., "Efficient and Targeted Delivery of siRNA in Vivo," FEBS (2010), vol. 277, p. 4814-4827.
Suvanasuthi et al., "Rapid transport of plasmid DNA into the nucleolus via actin depolymerization using the HVJ envelope vector," J Gene Med. (2007) 9(1):55-62.
Tan et al., "Cell or cell membrane-based drug delivery systems," Theranostics. (2015) 5(8): 863-81.
Wang et al., "AAV Gene Therapy Corrects OTC Deficiency and Prevents Liver Fibrosis in Aged OTC-Knock Out Heterozygous Mice," Molecular Genetics and Metabolism (Apr. 2017), vol. 120, p. 299-305.
Weiss et al., "Review, the blood-brain barrier in brain homeostasis and neurological diseases" Biochimica et Biophysica Acta 1788: 842-857, 2009.
Kanada et al., "Differential fates of biomolecules delivered to target cells via ex tracellular vesicles," Proc Natl Acad Sci USA (2015) vol. 112, E1433-E1442, pp. 1-10.
Katoh et al., "Exploitation of the interaction of measles virus fusogenic envelope proteins with the surface receptor CD46 on human cells for microcell-mediated chromosome transfer," BMC Biotechnology (2010) vol. 10, Article No. 37, pp. 1-13.
Kneissl et al., "Measles Virus Glycoprotein-Based Lentiviral Targeting Vectors That Avoid Neutralizing Antibodies," PLOS One (2012) vol. 7, No. 10, e46667, pp. 1-8.
Milani et al., "Phagocytosis-shielded lentiviral vectors improve liver gene therapy in nonhuman primates," Sci Transl Med. (2019) vol. 11, No. 493, eaav7325, pp. 1-14.
Nordlund et al.," Snare-fusion mediated insertion of membrane proteins into native and artificial membranes." Nature Communications (2014) vol. 5, No. 1, pp. 1-8.
Pichard et al., "Specific Micro-RNA regulated TetR-KRAB Transcriptional control of transgene expression in viral vector transduced cells," PLOS ONE (2012) vol. 7, No. 12, e51952, pp. 1-10.
Plemper et al., "Structural and mechanistic studies of measles virus illuminate paramyxovirus entry," PLoS Pathog. (2011) vol. 7, No. 6, e1002058, pp. 1-6.
Quinn et al., "Myomerger induces fusion of non-fusogenic cells and is required for myoblast fusion," Nature Communications (2017) vol. 8, Article No. 15665, pp. 1-9.
Sampaio et al., Membrane lipidome of an epithelial cell line. PNAS (2011) vol. 108, No. 5, pp. 1903-1907.
Publication of International Application No. PCT/US2019/061434 published May 22, 2020.
Internation Search Report and Written Opinion for International Application No. PCT/US2019/061434 dated Jun. 26, 2020.
Wheeler et al., "Proteomics analysis of cellular components in lentiviral vector production using Gel-LC-MS/MS," Proteomics (2007) vol. 1, No. 2, pp. 224-230.
Wigler et al., "Transfer of purified herpes virus thymidine kinase gene to cultured mouse cells," Cell (1977) vol. 11, pp. 223-232.
Arndt et al., "Rh(null) red blood cells with reduced CD47 do not show increased interactions with peripheral blood monocytes," Br J Haematol. (2004) vol. 125, No. 3, pp. 412-414.
Yang et al., "Virus?Mimetic Fusogenic Exosomes for Direct Delivery of Integral Membrane Proteins to Target Cell Membranes," Advanced Materials (2017) vol. 29, No. 13, pp. 1605604.
Ambrose, V. "The functions of animal microRNAs," Nature (2004) vol. 431, No. 7006, pp. 350-355.
Zennou et al., "HIV-1 genome nuclear import is mediated by a central DNA flap," Cell. (2000) vol. 101, No. 2, pp. 173-185.
Zhan et al., "Insulator: from chromatin domain boundary to gene regulation," Hum Genet. (2001) vol. 109, No. 5, pp. 471-478.
Zhou et al., "Exclusive Transduction of Human CD4+ T Cells upon Systemic Delivery of CD4-Targeted Lentiviral Vectors," J Immunol (2015) vol. 195, No. 5, pp. 2493-2501.
Zufferey et al., "Multiply attenuated lentiviral vector achieves efficient gene delivery in vivo," Nat. Biotech. (1997) vol. 15, No. 9, pp. 871-875.
Zufferey et al., "Woodchuck Hepatitis Virus Posttranscriptional Regulatory Element Enhances Expression of Transgenes Delivered by Retroviral Vectors," J Viral (1999) vol. 73, No. 4, pp. 2886-2892.
Allen et al., "Molecular definition of distinct cytoskeletal structures involved in complement- and Fc receptor-mediated phagocytosis in macrophages," J Exp Med. (1996) vol. 184, No. 2, pp. 627-637.
Aladjem et al., "Participation of the human beta-globin locus control region in initiation of DNA replication," Science (1995) vol. 270, No. 5237, pp. 815-819.
Zhang et al., "Measuring energy metabolism in cultured cells, including human pluripotent stem cells and differentiated cells," Nature Protocols (2012) vol. 7, pp. 1068-1085.
Yin et al. (2014). Non-viral vectors for gene-based therapy. Nat. Rev. Genet. vol. 15, No. 8, pp. 541-555.
Wubbolts et al., "Proteomic and biochemical analyses of human B cell-derived exosomes. Potential implications for their function and multivesicular body formation," J Biol Chem (2003) vol. 278, No. 13, pp. 10963-10972.
Van Besouw et al., "Donor-specific T-cell reactivity identifies kidney transplant patients in whom immunosuppressive therapy can be safely reduced," Transplantation (2000) vol. 70, No. 1, pp. 136-143.
Ui-Tei et al "Sensitive assay of RNA interference in Drosophila and Chinese hamster cultured cells using firefly uciferase gene as target" FEBS Letters (2000) vol. 479, pp. 79-82.
Salic et al. "A chemical method for fast and sensitive detection of DNA synthesis in vivo" PNAS (2008) vol. 105, No. 7, pp. 2415-2420.
Plant et al., "Notexin causes greater myotoxic damage and slower functional repair in mouse skeletal muscles than bupivacaine," Muscle and Nerve (2006) vol. 34, No. 5, pp. 577-585.
Lee et al., "A comparative study on the efficiency of two enucleation methods in pig somatic cell nuclear transfer: effects of the squeezing and the aspiration methods." Anim Biotechnol. (2008) vol. 19, No. 2, pp. 71-79.
Kainu et al., "Introduction of phospholipids to cultured cells with cyclodextrin," J Lipid Res. (2010) vol. 51, No. 12, pp. 3533-3541.
Jao et al., "Exploring RNA transcription and turnover in vivo by using click chemistry," Proc Natl Acad Sci USA (2008) vol. 105, No. 41, pp. 15779-15784.
Green et al. "Metabolic, enzymatic, and transporter responses in human muscle during three consecutive days of exercise and recovery" Am J Physiol Regul Integr Comp Physiol (2008) vol. 295, No. 4, pp. R12380-R12350.
Gendelman et al., "Monocyte Chemotactic Protein-1 Regulates Voltage-Gated K+ Channels and Macrophage Transmigration," J Neuroimmune Pharmacology (2009) vol. 4, pp. 47-59.
Galic et al., "Coordinated Regulation of Insulin Signaling by the Protein Tyrosine Phosphatases PTP1B and TCPTP," Mol Cel Biol (2005) vol. 25, No. 2, pp. 819-829.
Deleavey et al., "Designing Chemically Modified Oligonucleotides for Targeted Gene Silencing," Chem Biol (2012) vol. 19, No. 8, pp. 937-954.
Wen et al., "Anomalous correlation effects and unique phase diagram of electron-doped FeSe revealed by photoemission spectroscopy," Nature Communications (2016) vol. 7, article No. 10840.
Weber-Lolfi et al. "DNA import competence and mitochondrial genetics" Biopolymers and Cell. (2014) vol. 30, No. 1, pp. 71-73.

(56) References Cited

OTHER PUBLICATIONS

Thery et al. "Isolation and characterization of exosomes from cell culture supernatants and biological fluids," Curr Protoc Cell Biol (2006) Chapter 3:Unit 3.22.
Nesbitt et al., "Targeted Intracellular Therapeutic Delivery Using Liposomes Formulated with Multifunctional Fast proteins," (2012). Electronic Thesis and Dissertation Repository. 388. https://ir.lib.uwo.ca/etd/388.
Blazar et al., "Strategies to inhibit alloantibody production in alloprimed murine recipients of hematopoietic stem cell grafts," Am J Transplant (2015) vol. 15, No. 4, pp. 931-941.
Bayona-Bafaluy et al., "A chemical enucleation method for the transfer of mitochondrial DNA to ?° cells" Nucleic Acids Res. (2003) vol. 31, No. 16, e98, pp. 1-4.
Alvarez-Erviti et al., "Delivery of siRNA to the mouse brain by systemic injection of targeted exosomes." Nature Biotechnology (2011) 29(4): 341-345.
Chiriaco et al., "Dual-regulated Lentiviral Vector for Gene Therapy of X-linked Chronic Granulomatosis," Molecular Therapy (2014) vol. 22, No. 8, pp. 1472-1483.
Tang et al., "Therapeutic potential of CAR-T cell-derived exosomes: a cell-free modality for targeted cancer therapy," Oncotarget (2015) vol. 6, No. 42, pp. 44179-44190.
Bartel (2004). MicroRNAs: genomics, biogenesis, mechanism, and function. Cell 116(2): 281-297.
Augustin et al. (2005). Characterization of peptides released from mitochondria: evidence for constant proteolysis and peptide efflux. J. Biol. Chem. 280(4): 2691-2699.
Alfonzo et al. (2009). Mitochondrial tRNA import—the challenge to understand has just begun. Biol. Chem. 390(8): 717-722.
Burgess-Beusse et al., "The insulation of genes from external enhancers and silencing chromatin," Proc Natl Acad Sci U S A. (2002) vol. 99, Suppl 4, pp. 16433-16437.
Chen et al., "Real-time quantification of microRNAs by stem-loop RT-PCR," Nucleic Acids Res (2005) vol. 33, No. 20, e179, pp. 1-9.
Chung et al., "A 5' element of the chicken beta-globin domain serves as an insulator in human erythroid cells and protects against position effect in *Drosophila*," Cell. (1993) vol. 74, No. 3, pp. 505-514.
Cullen et al., "Regulatory pathways governing HIV-1 replication," Cell. (1989) vol. 58, No. 3, pp. 423-426.
Derse et al,., "Mutagenesis of EIAV TAT Reveals Structural Features Essential for Transcriptional Activation and TAR Element Recognition," Virology. (1993) vol. 194, No. 2, pp. 530-536.
Engelman et al., "Identification of conserved amino acid residues critical for human immunodeficiency virus type 1 integrase function in vitro.," J Virol. (1992) vol. 66, No. 11, pp. 6361-6369.
Fujioka et al., "A novel membrane glycoprotein, SHPS-1, that binds the SH2-domain-containing protein tyrosine phosphatase SHP-2 in response to mitogens and cell adhesion," Mol Cell Biol. (1996) vol. 16, No. 12, pp. 6887-6899.
Herzog et al. "LipidXplorer: A Software for Consensual Cross-Platform Lipidomics" PLOS One (2012) vol. 7, No. 1, e29851, pp. 1-7.
Herzog et al. (2011). A novel informatics concept for high-throughput shotgun lipidomics based on the molecular ragmentation query language. Genome Biol. vol. 12, No. 1, RB, pp. 1-25.
Huang et al., "Role of the hepatitis B virus posttranscriptional regulatory element in export of intronless transcripts," Mol Cell Biol (1995) vol. 15, No. 7, pp. 3864-3869.
Jacob et al. "Membrane cell permeabilisation with saponin and multiparametric analysis by flow cytometry" Cytometry (1991) vol. 12, No. 6, pp. 550-558.
Jeon et al. "In Vitro Model of Tumor Cell Extravasation" PLOS ONE (2013) vol. 8, No. 2, e56910, pp. 1-9.
Wu et al., "Combinatorial control of suicide gene expression by tissue-specific promoter and microRNA regulation for cancer therapy," Mol Ther. Dec. 2009;17(12):2058-66.
Zernecke et al., "Delivery of microRNA-126 by apoptotic bodies induces CXCL12-dependent vascular protection," Sci Signal. (2009) 2(100): ra81.
Zhang et al., "Cell-specific targeting of lentiviral vectors mediated by fusion proteins derived from Sindbis virus, vesicular stomatitis virus, or avian sarcoma/leukosis virus," Retrovirology. (2010) 7:3.
Abe et al., "Enhanced gene transfer with fusogenic liposomes containing vesicular stomatitis virus G glycoprotein," J Virol (1998) vol. 72, No. 7, pp. 6159-6163.
Adlakha-Hutcheon et al., "Controlled destabilization of a liposomal drug delivery system enhances mitoxantrone antitumor activity," Nat Biotechnol (1999) vol. 17, pp. 775-779.
Amendola et al., "Regulated and Multiple miRNA and siRNA Delivery Into Primary Cells by a Lentiviral Platform," Mol Ther (2009) vol. 17, No. 6, pp. 1039-1052.
Devos et al., "Practical Limits of Functional Prediction," Proteins: Structure, Function, and Genetics (2000) vol. 41, pp. 98-107.
Diederich et al., "Activation of the Nipah Virus Fusion Protein in MDCK Cells Is Mediated by Cathepsin B within the Endosome-Recycling Compartment," Journal of Virology (2012) 86(7):3736-3745.
Field et al. (Jan. 12, 2017), "Interleukin-2 receptor-alpha proximal promoter hypothylation is associated with multiple sclerosis," Genes and Immunity, 18, 59-66.
Follenzi et al. (2002), "Efficient Gene Delivery and Targeted Expression to Hepatocytes In Vivo by Improved Lentiviral Vectors," Human Gene Therapy, 13(2), 243-260.
Gascon et al., "Dual-promoter lentiviral vectors for constitutive and regulated gene expression in neurons," J Neurosci Methods (2008) vol. 168, pp. 104-112.
Gorelik et al. (Jan. 2002), "Transforming Growth Factor-Beta in T-Cell Biology," Nature Reviews Immunology, 2, 46-53.
Kaur et al. (2014), "CD47 Signaling Regulates the Immunosuppressive Activity of VEGF in T Cells," The Journal of Immunology, 193(8), 3914-3924.
Kisselev, "Polypeptide Release Factors in Prokaryotes and Ewukaryotes: Same Function, Different Structure," Structure (2002) vol. 10, pp. 8-9.
Nomura et al., "Microscopic observations reveal that fusogenic peptides induce liposome shrinkage prior to membrane fusion," PNAS (2004) vol. 101, No. 10, pp. 3420-3425.
Tolmachov et al. Chapter 13: Designing Lentiviral Gene Vectors, Book: Viral Gene Therapy, Jul. 2011.
Transfiguracion et al. (Sep. 18, 2020), "Rapid In-Process Monitoring of Lentiviral Vector Particles by High-Performance Liquid Chromatography.," Molecular Therapy: Methods & Clinicial Development, 18, 803-810.
Valastyan et al. (2010), "miR-31: A crucial overseer of tumor metastasis and other emerging roles," Cell Cycle, 9(11), 2124-2129.
Verhoeyen et al. (2008), "Production of Lentiviruses Displaying "Early-Acting" Cytokines for Selective Gene Transfer into Hematopoietic Stem Cells," Gene Therapy Protocols, 434(2), 99-112.
Whisstock et al., "Prediction of protein function from protein sequence and structure," Quarterly Reviews of Biopphysics (2003) vol. 36, No. 3, pp. 307-340.
Witkowski et al., "Conversion of a Beta-Ketoacyl Synthase to a Malonyl Decaboxylase by replacement of the Active-Site Cysteine with Glutamine," Biochemistry (1999) vol. 38, 11643-11650.
Hurton et al. (Nov. 20, 2009), "IL-7 as a Membrane-Bound Molecule for the Costimulation of Tumor-Specific T Cells," Blood, 112(3035), in 3 pages.
Morizono et al., "Lentiviral vector retargeting to P-glycoprotein on metastatic melanoma through intravenous injection," Nat Med. (2005) 11(3): 346-52. doi: 10.1038/nm1192.
Xu et al., "Host cell recognition by the henipaviruses: Crystal structures of the Nipah G attachment glycoprotein and its complex with ephrin-B3," PNAS (2008) 105(29):9953-9958.

* cited by examiner

| | Fusosomes | Parental Cells |
|---|---|---|
| Average diameter (nm) | 128.7 | 175.4 |
| Min Diameter (nm) | 14 | 29 |
| Max Diameter (nm) | 18720 | 19802 |
| Median Diameter (nm) | 134 | 99 |
| 10% Quantile (nm) | 53 | 52 |
| 25% Quantile (nm) | 88 | 66 |
| 75% Quantile (nm) | 226 | 241 |
| 90% Quantile (nm) | 4450 | 10649 |
| Average volume (μm$^3$) | 0.067 | 7.421 |

Fig. 3

| | Fusosomes | Parental Cells |
|---|---|---|
| Average diameter (nm) | 128.7 | 175.4 |
| Average volume ($\mu m^3$) | 0.067 | 7.421 |

Fig. 4

| | [Protein] (mg/mL) Insoluble | Soluble | Ratio |
|---|---|---|---|
| Cells | 2.12 | 0.06 | 0.028 |
| Fusosomes | 1.28 | 0.72 | 0.563 |

| Fusosome | Absolute amount of targeted fusion |
|---|---|
| MvH(CD8)+F | 48.8% |
| VSV-G | 0% |

| Group | % RFP conversion (± SD) |
|---|---|
| Recipient + no fusosome | 0.4 ± 0.2% |
| Recipient + NivG+F fusosome | 88.9 ± 3.4% |
| Recipient + NivG+F fusosome + Baf | 68.1 ± 2.7% |

Fig. 11

FUSOSOME COMPOSITIONS FOR T CELL DELIVERY

CROSS-REFERENCE TO RELATED APPLICATIONS

This application is a U.S. National Stage Application under 35 U.S.C. § 371 of International Application No. PCT/US2019/061434, filed Nov. 14, 2019, which claims priority to U.S. provisional applications 62/767,320, filed Nov. 14, 2018, entitled "FUSOSOME COMPOSITIONS FOR T CELL DELIVERY"; and 62/900,053, filed Sep. 13, 2019, entitled "FUSOSOME COMPOSITIONS FOR T CELL DELIVERY", the contents of each of which are incorporated by reference in their entirety for all purposes.

INCORPORATION BY REFERENCE OF SEQUENCE LISTING

The present application is being filed along with a Sequence Listing in electronic format. The Sequence Listing is provided as a file entitled 186152003240SeqList.TXT, created Nov. 14, 2019, which is 642,240 bytes in size. The information in the electronic format of the Sequence Listing is incorporated by reference in its entirety.

BACKGROUND

Complex biologics are promising therapeutic candidates for a variety of diseases. However, it is difficult to deliver large biologic agents into a cell because the plasma membrane acts as a barrier between the cell and the extracellular space. There is a need in the art for new methods of delivering complex biologics into cells in a subject.

SUMMARY

The present disclosure provides, at least in part, fusosome methods and compositions for in vivo delivery. In some embodiments, the fusosome comprises a combination of elements that promote specificity for target cells, e.g., one or more of a fusogen, a positive target cell-specific regulatory element, and a non-target cell-specific regulatory element. In some embodiments, the fusosome comprises one or more modifications that decrease an immune response against the fusosome.

ENUMERATED EMBODIMENTS

1. A fusosome comprising:
a) a lipid bilayer comprising a fusogen; and
b) a nucleic acid that comprises:
(i) a payload gene encoding an exogenous agent, e.g. a payload gene encoding an exogenous agent of Table 5; and
(ii) a positive target cell-specific regulatory element (e.g., a target cell-specific promoter) operatively linked to the payload gene, wherein the positive target cell-specific regulatory element increases expression of the payload gene in a target cell relative to an otherwise similar fusosome lacking the positive target cell-specific regulatory element, wherein the target cell is a T cell.

2. The fusosome of embodiment 1, wherein the nucleic acid further comprises a non-target cell-specific regulatory element (NTCSRE) (e.g., a non-target cell-specific miRNA recognition sequence), operatively linked to the payload gene, wherein the NTCSRE decreases expression of the payload gene in a non-target cell relative to an otherwise similar fusosome lacking the NTCSRE, optionally wherein the target cell is a first type of T cell and the non-target cell is a second, different type of T cell or a non-T cell, optionally wherein the target cell is a Treg cell and the non-target cell is a conventional CD4+ T cell.

3. A fusosome comprising:
a) a lipid bilayer comprising a fusogen; and
b) a nucleic acid that comprises:
(i) a payload gene encoding an exogenous agent, e.g., an exogenous agent of Table 5; and
(ii) a promoter operatively linked to the payload gene, wherein the promoter is chosen from an IL2RA, LRRC32, FOXP3, or IKZF2 promoter, e.g., according to a sequence of a promoter in Table 3, or a sequence having at least 70%, 75%, 80%, 85%, 90%, 95%, 96%, 97%, 98%, or 99% identity thereto.

4. A fusosome comprising:
a) a lipid bilayer comprising a fusogen; and
b) a nucleic acid that comprises:
(i) a payload gene encoding an exogenous agent, e.g. a payload gene encoding an exogenous agent of Table 5; and
(ii) a non-target cell-specific regulatory element (NTCSRE) (e.g., a non-target cell-specific miRNA recognition sequence), that is a non-T-cell-specific regulatory element, operatively linked to the payload gene, wherein the NTCSRE decreases expression of the payload gene in a non-target cell or tissue relative to an otherwise similar fusosome lacking the NTCSRE.

5. A fusosome comprising:
a) a lipid bilayer comprising a fusogen; and
b) a nucleic acid that comprises:
(i) a payload gene encoding an exogenous agent, e.g. a payload gene encoding an exogenous agent of Table 5; and
(ii) a negative target cell-specific regulatory element (negative TCSRE) (e.g., a tissue-specific miRNA recognition sequence), that is a non-T-cell-specific regulatory element operatively linked to the payload gene, wherein the negative TCSRE decreases expression of the exogenous agent in a non-target cell or tissue relative to an otherwise similar nucleic acid lacking the negative TCSRE.

6. The fusosome of either embodiment 4 or 5, wherein the nucleic acid further comprises a positive target cell-specific regulatory element (e.g., a target cell-specific promoter) operatively linked to the payload gene, wherein the positive target cell-specific regulatory element increases expression of the payload gene in a target cell relative to an otherwise similar fusosome lacking the positive target cell-specific regulatory element, wherein the target cell is a first type of T cell, optionally wherein the non-target cell is a second, different type of T cell or a non-T cell, optionally wherein the target cell is a Treg cell and the non-target cell is a conventional CD4+ T cell.

7. A fusosome comprising:
a) a lipid bilayer comprising a fusogen;
b) a nucleic acid that comprises a payload gene encoding an exogenous agent, e.g. a payload gene encoding an exogenous agent of Table 5; and
c) one or both of:
(i) a first exogenous or overexpressed immunosuppressive protein on the lipid bilayer; or (ii) a first immunostimulatory protein that is absent or present at reduced levels (e.g., reduced by at least 10%, 20%, 30%, 40%, 50%, 60%, 70%, 80%, or 90%) compared to a fusosome generated from an otherwise similar, unmodified source cell.

8. The fusosome of any of the preceding embodiments, wherein one or more of:

i) the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, 2-fold, 3-fold, 4-fold, 5-fold, 10-fold, 20-fold, 50-fold, or 100-fold;

ii) the fusosome fuses at a higher rate with a target cell than with another fusosome, e.g., by at least 10%, 20%, 30%, 40%, 50%, 60%, 70%, 80%, or 90%, 2-fold, 3-fold, 4-fold, 5-fold, 10-fold, 20-fold, 50-fold, or 100-fold;

iii) the fusosome fuses with target cells at a rate such that an agent in the fusosome is delivered to at least 10%, 20%, 30%, 40%, 50%, 60%, 70%, 80%, or 90%, of target cells after 24, 48, or 72 hours;

iv) the fusosome delivers the nucleic acid, e.g., retroviral nucleic acid, to a target cell at a higher rate than to a non-target cell, e.g., by at least at least 1%, 2%, 3%, 4%, 5%, 10%, 20%, 30%, 40%, 50%, 60%, 70%, 80%, 90%, 2-fold, 3-fold, 4-fold, 5-fold, 10-fold, 20-fold, 50-fold, or 100-fold;

v) the fusosome delivers the nucleic acid, e.g., retroviral nucleic acid, to a target cell at a higher rate than to another fusosome, e.g., by at least 10%, 20%, 30%, 40%, 50%, 60%, 70%, 80%, or 90%, 2-fold, 3-fold, 4-fold, 5-fold, 10-fold, 20-fold, 50-fold, or 100-fold; or vi) the fusosome delivers the nucleic acid, e.g., retroviral nucleic acid, to a target cell at a rate such that an agent in the fusosome is delivered to at least 10%, 20%, 30%, 40%, 50%, 60%, 70%, 80%, or 90%, of target cells after 24, 48, or 72 hours.

9. The fusosome of any of the preceding embodiments, wherein one or more of (e.g., 2 or all 3 of) the following apply: the fusosome is a retroviral vector, the lipid bilayer is comprised by an envelope, e.g., a viral envelope, and the nucleic acid is a retroviral nucleic acid.

10. The fusosome of any of the preceding embodiments, wherein the nucleic acid comprises one or more of (e.g., all of) the following nucleic acid sequences: 5' LTR (e.g., comprising U5 and lacking a functional U3 domain), Psi packaging element (Psi), Central polypurine tract (cPPT) Promoter operatively linked to the payload gene, payload gene (optionally comprising an intron before the open reading frame), Poly A tail sequence, WPRE, and 3' LTR (e.g., comprising U5 and lacking a functional U3).

11. The fusosome of any of the preceding embodiments, which comprises one or more of (e.g., all of) a polymerase (e.g., a reverse transcriptase, e.g., pol or a portion thereof), an integrase (e.g., pol or a portion thereof, e.g., a functional or non-functional variant), a matrix protein (e.g., gag or a portion thereof), a capsid protein (e.g., gag or a portion thereof), a nucleocaspid protein (e.g., gag or a portion thereof), and a protease (e.g., pro).

12. The fusosome of embodiment 7, which comprises (i) and (ii).

13. The fusosome of any of embodiments 7-12, which further comprises a second exogenous or overexpressed immunosuppressive protein on the lipid bilayer.

14. The fusosome of any of embodiments 7-13, which further comprises a second immunostimulatory protein that is absent or present at reduced levels (e.g., reduced by at least 10%, 20%, 30%, 40%, 50%, 60%, 70%, 80%, or 90%) compared to a fusosome generated from an otherwise similar, unmodified source cell.

15. The fusosome of any of embodiments 7-14, wherein the nucleic acid, e.g., retroviral vector, further comprises a positive target cell-specific regulatory element (e.g., a target cell-specific promoter) operatively linked to the payload gene, wherein the positive target cell-specific regulatory element increases expression of the payload gene in a target cell relative to an otherwise similar fusosome lacking the positive target cell-specific regulatory element, wherein the target cell is a T cell.

16. The fusosome of any of embodiments 7-15, wherein the nucleic acid, e.g., retroviral nucleic acid, further comprises a non-target cell-specific regulatory element (NTCSRE) (e.g., a non-target cell-specific miRNA recognition sequence), operatively linked to the payload gene, wherein the NTCSRE decreases expression of the payload gene in a non-target cell or tissue relative to an otherwise similar fusosome lacking the NTCSRE, optionally wherein the target cell is a first type of T cell and the non-target cell is a second, different type of T cell or a non-T cell, optionally wherein the target cell is a Treg cell and the non-target cell is a conventional CD4+ T cell.

17. The fusosome of any of embodiments 7-15, wherein the nucleic acid, e.g., retroviral nucleic acid, further comprises a negative target cell-specific regulatory element (negative TCSRE) (e.g., a tissue-specific miRNA recognition sequence), operatively linked to the payload gene, wherein the negative TCSRE decreases expression of the exogenous agent in a non-target cell or tissue relative to an otherwise similar nucleic acid, e.g., retroviral nucleic acid, lacking the negative TCSRE.

18. The fusosome of any of embodiments 7-17, wherein, when administered to a subject (e.g., a human subject or a mouse), one or more of:

i) the fusosome does not produce a detectable antibody response (e.g., after a single administration or a plurality of administrations), or antibodies against the fusosome are present at a level of less than 10%, 5%, 4%, 3%, 2%, or 1% above a background level, e.g., by a FACS antibody detection assay, e.g., an assay of Example 13 or Example 14);

ii) the fusosome does not produce a detectable cellular immune response (e.g., T cell response, NK cell response, or macrophage response), or a cellular immune response against the fusosome is present at a level of less than 10%, 5%, 4%, 3%, 2%, or 1% above a background level, e.g., by a PBMC lysis assay (e.g., an assay of Example 5), by an NK cell lysis assay (e.g., an assay of Example 6), by a CD8 killer T cell lysis assay (e.g., an assay of Example 7), or by a macrophage phagocytosis assay (e.g., an assay of Example 8);

iii) the fusosome does not produce a detectable innate immune response, e.g., complement activation (e.g., after a single administration or a plurality of administrations), or the innate immune response against the fusosome is present at a level of less than 10%, 5%, 4%, 3%, 2%, or 1% above a background level, e.g., by a complement activity assay (e.g., an assay of Example 9);

iv) less than 10%, 5%, 4%, 3%, 2%, or 1% of fusosomes are inactivated by serum, e.g., by a serum inactivation assay, e.g., an assay of Example 11 or Example 12;

v) a target cell that has received the exogenous agent from the fusosome does not produce a detectable antibody response (e.g., after a single administration or a plurality of administrations), or antibodies against the target cell are present at a level of less than 10%, 5%, 4%, 3%, 2%, or 1% above a background level, e.g., by a FACS antibody detection assay, e.g., an assay of Example 15; or vi) a target cell that has received the exogenous agent from the fusosome does not produce a detectable cellular immune response (e.g., T cell response, NK cell response, or macrophage response), or a cellular response against the target cell is present at a level of less than 10%, 5%, 4%, 3%, 2%, or 1% above a background level, e.g., by a macrophage phagocytosis assay (e.g., an assay of Example 16), by a PBMC lysis assay (e.g., an assay of Example 17), by an NK cell lysis assay (e.g., an assay of Example 18), or by a CD8 killer T cell lysis assay (e.g., an assay of Example 19).

19. The fusosome of embodiment 18, wherein the background level is the corresponding level in the same subject prior to administration of the fusosome.

20. The fusosome of any of embodiments 7-19, wherein the immunosuppressive protein (e.g., first immunosuppressive protein or second immunosuppressive protein) is a complement regulatory protein or CD47.

21 The fusosome of any of embodiments 7-20, wherein the immunostimulatory protein (e.g., first immunostimulatory protein or second immunostimulatory protein) is an MHC I (e.g., HLA-A, HLA-B, HLA-C, HLA-E, or HLA-G) or MHC II (e.g., HLA-DP, HLA-DM, HLA-DOA, HLA-DOB, HLA-DQ, or HLA-DR) protein.

22. The fusosome of any of the preceding embodiments, wherein the exogenous agent is a binding moiety (e.g., a CAR molecule) that binds to an antigen chosen from: a hair follicle keratinocyte antigen, a melanocyte antigen, CXCL8, CXCL9, CXCL10, CXCL11, CCL2, CCL5, intercellular adhesion molecule 1, gluten, PDGF, bacterial flagellin, FAM84A, Alpha (2)-Heremans Schmidt glycoprotein (alpha (2)-HSG), transferrin, carbonic anhydrase, a food-based antigen, thyroid-stimulating hormone receptor (TSHR), thryoid peroxidase, thyroglobulin, the TSH receptor, alpha-enolase, alpha b-crystallin, beta-arrestin, S100-beta, aquaporin-4, MOG, PLP, MBP, nAChR, MuSK, the NC16A terminal of BPAG1/2, Desmoglein 1, Desmoglein 3, BPAG1, plectin, desmoplakin I, desmoplakin II, envoplakin, periplakin, alpha-2-macroglobulin-like-1, a citrullinated peptide, a non-self antigen, dsDNA, nucelosome histones, telomeres, a Sm core protein, hsp60, 437-460 (p277), PPIns/Pins, an anti-insulin antigen, glutamate decarboxylase (GAD), carboxypeptidase H, insulinoma antigen-2, IA-2B, or an antigen in the cytoplasm of neutrophil granulocytes.

23 The fusosome of any of the preceding embodiments, wherein the fusogen comprises VSV-G.

24. The fusosome of any embodiments 1, 2, 6, 15, 22, or 23, wherein the positive target cell-specific regulatory element comprises a T cell-specific promoter, a T cell-specific enhancer, a T cell-specific splice site, a T cell-specific site extending half-life of an RNA or protein, a T cell-specific mRNA nuclear export promoting site, a T cell-specific translational enhancing site, or a T cell-specific post-translational modification site.

25. The fusosome of any embodiments 1, 2, 6, 15, or 22-24, wherein the positive target cell-specific regulatory element comprises a T cell-specific promoter.

26. The fusosome of embodiment 25, wherein the T cell-specific promoter comprises a motif of Table 3.

27. The fusosome of embodiment 25 or 26, wherein the positive T cell-specific regulatory element comprises a promoter chosen from an IL2RA, LRRC32, FOXP3, or IKZF2 promoter.

28. The fusosome of any of embodiments 4-6, or 16-21, wherein the negative TCSRE or NTCSRE comprises a non-target cell-specific miRNA recognition sequence, non-target cell-specific protease recognition site, non-target cell-specific ubiquitin ligase site, non-target cell-specific transcriptional repression site, or non-target cell-specific epigenetic repression site.

29. The fusosome of any of embodiments 4-6, 16-21, or 28, wherein the negative TCSRE or NTCSRE comprises a tissue-specific miRNA recognition sequence, tissue-specific protease recognition site, tissue-specific ubiquitin ligase site, tissue-specific transcriptional repression site, or tissue-specific epigenetic repression site.

30. The fusosome of any of embodiments 4-6, 16-21, 28, or 29, wherein the negative TCSRE or NTCSRE comprises a non-target cell-specific miRNA recognition sequence, non-target cell-specific protease recognition site, non-target cell-specific ubiquitin ligase site, non-target cell-specific transcriptional repression site, or non-target cell-specific epigenetic repression site.

31. The fusosome of any of embodiments 4-6, 16-21, or 28-30, wherein the negative TCSRE or NTCSRE comprises a non-target cell-specific miRNA recognition sequence bound by a miRNA of Table 4, e.g., by one or more of (e.g., two or more of) miR31, miR363, or miR29c.

32. The fusosome of any of embodiments 28-31, wherein the negative TCSRE or NTCSRE is situated or encoded within a transcribed region (e.g., the transcribed region encoding the exogenous agent), e.g., such that an RNA produced by the transcribed region comprises the miRNA recognition sequence within a UTR or coding region.

33. The fusosome of any of the preceding embodiments, wherein the nucleic acid, e.g., retroviral nucleic acid, comprises one or more insulator elements.

34 The fusosome of embodiment 33, wherein the nucleic acid, e.g., retroviral nucleic acid, comprises two insulator elements, e.g., a first insulator element upstream of the payload gene and a second insulator element downstream of the payload gene, e.g., wherein the first insulator element and second insulator element comprise the same or different sequences.

35. The fusosome of any of the preceding embodiments, which is not genotoxic or does not increase the rate of tumor formation in target cells.

36. The fusosome of any of the preceding embodiments, wherein the nucleic acid, e.g., retroviral nucleic acid, is capable of integrating into the genome of a target cell.

37. The fusosome of embodiment 36, wherein the nucleic acid, e.g., retroviral nucleic acid, is an integration-competent lentivirus or an integration-deficient lentivirus.

38. The fusosome of any of the preceding embodiments, wherein the target cell is chosen from a T cell, a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3- type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell.

39. The fusosome of any of embodiments 4-6 and 9-38, wherein one or more of:

i) less than 10%, 5%, 4%, 3%, 2%, or 1% of the exogenous agent detectably present in the subject is in non-target cells;

ii) at least 90%, 95%, 96%, 97%, 98%, or 99% of the cells of the subject that detectably comprise the exogenous agent, are target cells (e.g., cells of a single cell type);

iii) less than 1,000,000, 500,000, 200,000, 100,000, 50,000, 20,000, or 10,000 cells of the cells of the subject that detectably comprise the exogenous agent are non-target cells;

iv) average levels of the exogenous agent in all target cells in the subject are at least 100-fold, 200-fold, 500-fold, or 1,000-fold higher than average levels of the exogenous agent in all non-target cells in the subject; or v) the exogenous agent is not detectable in any non-target cell in the subject.

40. The fusosome of any of the preceding embodiments, wherein the nucleic acid, e.g., retroviral nucleic acid, encodes a positive TCSRE and/or a NTCSRE or negative TCSRE.

41. The fusosome of any of the preceding embodiments, wherein the nucleic acid, e.g., retroviral nucleic acid, comprises the complement of a positive TCSRE and/or a NTCSRE or negative TCSRE.

42. The fusosome of either embodiment 40 or 41, wherein the positive TCSRE comprises a target cell-specific promoter that is at least 10%, 25%, 50%, 75%, 100%, 150%, 200%, 250%, 300%, 400%, 500%, 750%, 1000% or more active in a target cell than a non-target cell.

43. The fusosome of any of embodiments 40-42, wherein the negative TCSRE or NTCSRE comprises a miRNA recognition sequence that decreases gene expression by at least 10%, 25%, 50%, 75%, or 100% in a non-target cell compared to a target cell.

44. The fusosome of any of the preceding embodiments, which does not deliver nucleic acid, e.g., retroviral nucleic acid, to a non-target cell, e.g., a conventional CD4+ T cell, an antigen presenting cell, an MHC class II+ cell, a professional antigen presenting cell, an atypical antigen presenting cell, a macrophage, a dendritic cell, a myeloid dendritic cell, a plasmacyteoid dendritic cell, a CD11c+ cell, a CD11b+ cell, a splenocyte, a B cell, a hepatocyte, a endothelial cell, or a non-cancerous cell.

45. The fusosome of any of the preceding embodiments, wherein less than 10%, 5%, 2.5%, 1%, 0.5%, 0.1%, 0.01%, 0.001%, 0.0001%, 0.00001%, or 0.000001% of a non-target cell type (e.g., one or more of a conventional CD4+ T cell, an antigen presenting cell, an MHC class II+ cell, a professional antigen presenting cell, an atypical antigen presenting cell, a macrophage, a dendritic cell, a myeloid dendritic cell, a plasmacyteoid dendritic cell, a CD11c+ cell, a CD11b+ cell, a splenocyte, a B cell, a hepatocyte, a endothelial cell, or a non-cancerous cell) comprise the nucleic acid, e.g., retroviral nucleic acid, e.g., using quantitative PCR, e.g., using an assay of Example 1.

46. The fusosome of any of the preceding embodiments, wherein the target cells comprise 0.00001-10, 0.0001-10, 0.001-10, 0.01-10, 0.1-10, 0.5-5, 1-4, 1-3, or 1-2 copies of the nucleic acid, e.g., retroviral nucleic acid, or a portion thereof, per host cell genome, e.g., wherein copy number of the nucleic acid, e.g., retroviral nucleic acid, is assessed after administration in vivo.

47. The fusosome of any of the preceding embodiments, wherein:

less than 10%, 5%, 2.5%, 1%, 0.5%, 0.1%, 0.01% of the non-target cells (e.g., a conventional CD4+ T cell, an antigen presenting cell, an MHC class II+ cell, a professional antigen presenting cell, an atypical antigen presenting cell, a macrophage, a dendritic cell, a myeloid dendritic cell, a plasmacyteoid dendritic cell, a CD11c+ cell, a CD11b+ cell, a splenocyte, a B cell, a hepatocyte, a endothelial cell, or a non-cancerous cell) comprise the exogenous agent; or the exogenous agent (e.g., protein) is not detectably present in a non-target cell, e.g., a conventional CD4+ T cell, an antigen presenting cell, an MHC class II+ cell, a professional antigen presenting cell, an atypical antigen presenting cell, a macrophage, a dendritic cell, a myeloid dendritic cell, a plasmacyteoid dendritic cell, a CD11c+ cell, a CD11b+ cell, a splenocyte, a B cell, a hepatocyte, a endothelial cell, or a non-cancerous cell.

48. The fusosome of any of the preceding embodiments, wherein the fusosome delivers the nucleic acid, e.g., retroviral nucleic, acid to a target cell, e.g., a T cell, a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell.

49. The fusosome of any of the preceding embodiments, wherein at least 0.00001%, 0.0001%, 0.001%, 0.001%, 0.01%, 0.1%, 1%, 2%, 5%, 10%, 20%, 30%, 40%, 50%, 60%, 70%, 80%, or 90% of target cells (e.g., one or more of a T cell, a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell) comprise the nucleic acid, e.g., retroviral nucleic acid, e.g., using quantitative PCR, e.g., using an assay of Example 3.

50. The fusosome of any of the preceding embodiments, wherein at least 0.00001%, 0.0001%, 0.001%, 0.001%, 0.01%, 0.1%, 1%, 2%, 5%, 10%, 20%, 30%, 40%, 50%, 60%, 70%, 80%, or 90% of target cells (e.g., a T cell, a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell) comprise the exogenous agent.

51. The fusosome of any of the preceding embodiments, wherein, upon administration, the ratio of target cells comprising the nucleic acid, e.g., retroviral nucleic acid, to non-target cells comprising the nucleic acid, e.g., retroviral nucleic acid, is at least 1.5, 2, 3, 4, 5, 10, 25, 50, 100, 500, 1000, 5000, 10,000, e.g., according to a quantitative PCR assay, e.g., using assays of Example 1 and Example 3.

52. The fusosome of any of the preceding embodiments, wherein the ratio of the average copy number of nucleic acid, e.g., retroviral nucleic acid, or a portion thereof in target cells to the average copy number of nucleic acid, e.g., retroviral nucleic acid, or a portion thereof in non-target cells is at least 1.5, 2, 3, 4, 5, 10, 25, 50, 100, 500, 1000, 5000, 10,000, e.g., according to a quantitative PCR assay, e.g., using assays of Example 1 and Example 3.

53. The fusosome of any of the preceding embodiments, wherein the ratio of the median copy number of of nucleic acid, e.g., retroviral nucleic acid, or a portion thereof in target cells to the median copy number of nucleic acid, e.g., retroviral nucleic acid, or a portion thereof in non-target cells is at least 1.5, 2, 3, 4, 5, 10, 25, 50, 100, 500, 1000, 5000, 10,000, e.g., according to a quantitative PCR assay, e.g., using assays of Example 1 and Example 3.

54. The fusosome of any of the preceding embodiments, wherein the ratio of target cells comprising the exogenous RNA agent to non-target cells comprising the exogenous RNA agent is at least 1.5, 2, 3, 4, 5, 10, 25, 50, 100, 500, 1000, 5000, 10,000, e.g., according to a reverse transcription quantitative PCR assay.

55. The fusosome of any of the preceding embodiments, wherein the ratio of the average exogenous RNA agent level of target cells to the average exogenous RNA agent level of non-target cells is at least 1.5, 2, 3, 4, 5, 10, 25, 50, 100, 500, 1000, 5000, 10,000, e.g., according to a reverse transcription quantitative PCR assay.

56. The fusosome of any of the preceding embodiments, wherein the ratio of the median exogenous RNA agent level of target cells to the median exogenous RNA agent level of non-target cells is at least 1.5, 2, 3, 4, 5, 10, 25, 50, 100, 500, 1000, 5000, 10,000, e.g., according to a reverse transcription quantitative PCR assay.

57. The fusosome of any of the preceding embodiments, wherein the ratio of target cells comprising the exogenous protein agent to non-target cells comprising the exogenous protein agent is at least 1.5, 2, 3, 4, 5, 10, 25, 50, 100, 500, 1000, 5000, 10,000, e.g., according to a FACS assay, e.g., using assays of Example 2 and Example 4.

58. The fusosome of any of the preceding embodiments, wherein the ratio of the average exogenous protein agent level of target cells to the average exogenous protein agent level of non-target cells is at least 1.5, 2, 3, 4, 5, 10, 25, 50, 100, 500, 1000, 5000, 10,000, e.g., according to a FACS assay, e.g., using assays of Example 2 and Example 4.

59 The fusosome of any of the preceding embodiments, wherein the ratio of the median exogenous protein agent level of target cells to the median exogenous protein agent level of non-target cells is at least 1.5, 2, 3, 4, 5, 10, 25, 50, 100, 500, 1000, 5000, 10,000, e.g., according to a FACS assay, e.g., using assays of Example 2 and Example 4.

60. The fusosome of any of the preceding embodiments, which comprises one or both of:

i) an exogenous or overexpressed immunosuppressive protein on the lipid bilayer, e.g., envelope; and ii) an immunostimulatory protein that is absent or present at reduced levels (e.g., reduced by at least 10%, 20%, 30%, 40%, 50%, 60%, 70%, 80%, or 90%) compared to a fusosome generated from an otherwise similar, unmodified source cell.

61. The fusosome of any of the preceding embodiments, which comprises one or more of:

i) a first exogenous or overexpressed immunosuppressive protein on the lipid bilayer, e.g., envelope, and a second exogenous or overexpressed immunosuppressive protein on the lipid bilayer, e.g., envelope;

ii) a first exogenous or overexpressed immunosuppressive protein on the lipid bilayer, e.g., envelope, and a second immunostimulatory protein that is absent or present at reduced levels (e.g., reduced by at least 10%, 20%, 30%, 40%, 50%, 60%, 70%, 80%, or 90%) compared to a fusosome generated from an otherwise similar, unmodified source cell; or iii) a first immunostimulatory protein that is absent or present at reduced levels (e.g., reduced by at least 10%, 20%, 30%, 40%, 50%, 60%, 70%, 80%, or 90%) compared to a fusosome generated from an otherwise similar, unmodified source cell and a second immunostimulatory protein that is absent or present at reduced levels (e.g., reduced by at least 10%, 20%, 30%, 40%, 50%, 60%, 70%, 80%, or 90%) compared to a fusosome generated from an otherwise similar, unmodified source cell.

62. The fusosome of any of the preceding embodiments, wherein the fusosome is in circulation at least 0.5, 1, 2, 3, 4, 6, 12, 18, 24, 36, or 48 hours after administration to the subject.

63. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 30 minutes after administration.

64. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 1 hour after administration.

65. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 2 hours after administration.

66. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 4 hours after administration.

67 The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 8 hours after administration.

68. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 12 hours after administration.

69 The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 18 hours after administration.

70. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 24 hours after administration.

71. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 36 hours after administration.

72. The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are in circulation 48 hours after administration.

73. The fusosome of any of the preceding embodiments, which has a reduction in immunogenicity as measured by a reduction in humoral response following one or more administration of the fusosome to an appropriate animal model, e.g., an animal model described herein, compared to reference fusosome, e.g., an unmodified fusosome otherwise similar to the fusosome.

74. The fusosome of embodiment 73, wherein the reduction in humoral response is measured in a serum sample by an anti-cell antibody titre, e.g., anti-retroviral antibody titre, e.g., by ELISA.

75. The fusosome of any of the preceding embodiments, wherein a serum sample from animals administered the fusosome has a reduction of 1%, 5%, 10%, 20%, 30%, 40%, 50%, 60%, 70%, 80%, 90%, or more of an anti-fusosome antibody titer compared to the serum sample from a subject administered an unmodified cell.

76. The fusosome of any of the preceding embodiments, wherein a serum sample from a subject administered the fusosome has an increased anti-cell antibody titre, e.g., increased by 1%, 2%, 5%, 10%, 20%, 30%, or 40% from baseline, e.g., wherein baseline refers to serum sample from the same subject before administration of the fusosome.

77. The fusosome of any of the preceding embodiments, wherein:

the subject to be administered the fusosome or a pharmaceutical composition comprising the fusosome has, or is known to have, or is tested for, a pre-existing antibody (e.g., IgG or IgM) reactive with the fusosome;

the subject to be administered the fusosome does not have detectable levels of a pre-existing antibody reactive with the fusosome;

a subject that has received the fusosome or a pharmaceutical composition comprising the fusosome has, or is known to have, or is tested for, an antibody (e.g., IgG or IgM) reactive with the fusosome;

the subject that received the fusosome or a pharmaceutical composition comprising the fusosome (e.g., at least once, twice, three times, four times, five times, or more) does not have detectable levels of antibody reactive with the fusosome; or levels of antibody do not rise more than 1%, 2%, 5%, 10%, 20%, or 50% between two timepoints, the first timepoint being before the first administration of the fusosome, and the second timepoint being after one or more administrations of the fusosome.

78. The fusosome of any of the preceding embodiments, wherein the fusosome is produced by the methods of Example 5, 6, or 7, e.g., from cells transfected with HLA-G or HLA-E cDNA.

79. The fusosome of any of the preceding embodiments, wherein fusosomes generated from NMC-HLA-G cells have a decreased percentage of lysis, e.g., PBMC mediated lysis, NK cell mediated lysis, and/or CD8+ T cell mediated lysis, at specific timepoints as compared to fusosomes generated from NMCs or NMC-empty vector.

80 The fusosome of any of the preceding embodiments, wherein the modified fusosome evades phagocytosis by macrophages.

81. The fusosome of any of the preceding embodiments, wherein the fusosome is produced by the methods of Example 8, e.g., from cells transfected with CD47 cDNA.

82. The fusosome of any of the preceding embodiments, wherein the phagocytic index is reduced when macrophages are incubated with fusosomes derived from NMC-CD47, versus those derived from NMC, or NMC-empty vector.

83. The fusosome of any of the preceding embodiments, which has a reduction in macrophage phagocytosis, e.g., a reduction of 1%, 5%, 10%, 20%, 30%, 40%, 50%, 60%, 70%, 80%, 90%, or more in macrophage phagocytosis compared to a reference fusosome, e.g., an unmodified fusosome otherwise similar to the fusosome, wherein the reduction in macrophage phagocytosis is determined by assaying the phagocytosis index in vitro, e.g., as described in Example 8.

84. The fusosome of any of the preceding embodiments, wherein the fusosome composition has a phagocytosis index of 0, 1, 10, 100, or more, e.g., as measured by an assay of Example 8, when incubated with macrophages in an in vitro assay of macrophage phagocytosis.

85. The fusosome of any of the preceding embodiments, which is modified and has reduced complement activity compared to an unmodified fusosome.

86. The fusosome of any of the preceding embodiments, which is produced by the methods of Example 9, e.g., from cells transfected with a cDNA coding for a complement regulatory protein, e.g., DAF.

87. The fusosome of any of the preceding embodiments, wherein the dose of fusosome at which 200 μg/ml of C3a is present is greater for the modified fusosome (e.g., HEK293-DAF) incubated with corresponding mouse sera (e.g., HEK-293 DAF mouse sera) than for the reference fusosome (e.g., HEK293 retroviral vector) incubated with corresponding mouse sera (e.g., HEK293 mouse sera).

88. The fusosome of any of the preceding embodiments, wherein the dose of fusosome at which 200 μg/ml of C3a is present is greater for for the modified fusosome (e.g., HEK293-DAF) incubated with naive mouse sera than for the reference fusosome (e.g., HEK293 retroviral vector) incubated with naive mouse sera.

89 The fusosome of any of the preceding embodiments, wherein the fusosome is resistant to complement mediated inactivation in patient serum 30 minutes after administration according to an assay of Example 9.

90 The fusosome of any of the preceding embodiments, wherein at least 0.001%, 0.01%, 0.1%, 1%, 10%, 20%, 30%, 40%, 50%, 60%, 70%, 80%, 90%, or 100% of fusosomes are resistant to complement mediated inactivation.

91. The fusosome of any of embodiments 86-90, wherein the complement regulatory protein comprises one or more of proteins that bind decay-accelerating factor (DAF, CD55), e.g. factor H (FH)-like protein-1 (FHL-1), e.g. C4b-binding protein (C4BP), e.g. complement receptor 1 (CD35), e.g. Membrane cofactor protein (MCP, CD46), eg. Protectin (CD59), e.g. proteins that inhibit the classical and alternative complement pathway CD/C5 convertase enzymes, e.g. proteins that regulate MAC assembly.

92. The fusosome of any of the preceding embodiments, which is produced by the methods of Example 10, e.g., from cells transfected with a DNA coding for an shRNA targeting MHC class I, e.g., wherein retroviral vectors derived from NMC-shMHC class I has lower expression of MHC class I compared to NMCs and NMC-vector control.

93. The fusosome of any of the preceding embodiments, wherein a measure of immunogenicity for fusosomes is serum inactivation, e.g., serum inactivation measured as described herein, e.g., as described in Example 11.

94. The fusosome of any of the preceding embodiments, wherein the percent of cells which receive the exogenous agent is not different between fusosome samples that have been incubated with serum and heat-inactivated serum from fusosome naïve mice.

95. The fusosome of any of the preceding embodiments, wherein the percent of cells which receive the exogenous agent is not different between fusosome samples that have been incubated with serum from fusosome naïve mice and no-serum control incubations.

96. fusosome of any of the preceding embodiments, wherein the percent of cells which receive the exogenous agent is less in fusosome samples that have been incubated with positive control serum than in fusosome samples that have been incubated with serum from fusosome naïve mice.

97. The fusosome of any of the preceding embodiments, wherein a modified fusosome, e.g., modified by a method described herein, has a reduced (e.g., reduced compared to administration of an unmodified fusosome) serum inactivation following multiple (e.g., more than one, e.g., 2 or more), administrations of the modified fusosome.

98. The fusosome of any of the preceding embodiments, wherein a fusosome described herein is not inactivated by serum following multiple administrations.

99. The fusosome of any of the preceding embodiments, wherein a measure of immunogenicity for the fusosome is serum inactivation, e.g., after multiple administrations, e.g., serum inactivation after multiple administrations measured as described herein, e.g., as described in Example 12.

100. The fusosome of any of the preceding embodiments, wherein the percent of cells which receive the exogenous agent is not different between fusosome samples that have been incubated with serum and heat-inactivated serum from mice treated with modified (e.g., HEK293-HLA-G) fusosomes.

101. The fusosome of any of the preceding embodiments, wherein the percent of cells which receive the exogenous agent is not different between fusosome samples that have been incubated from mice treated 1, 2, 3, 5 or 10 times with modified (e.g., HEK293-HLA-G) fusosomes.

102. The fusosome of any of the preceding embodiments, wherein the percent of cells which receive the exogenous agent is not different between fusosome samples that have been incubated with serum from mice treated with vehicle and from mice treated with modified (e.g., HEK293-HLA-G) fusosomes.

103. The fusosome of any of the preceding embodiments, wherein the percent of cells which receive the exogenous agent is less for fusosomes derived from a reference cell (e.g., HEK293) than for modified (e.g., HEK293-HLA-G) fusosomes.

104. The fusosome of any of the preceding embodiments, wherein a measure of immunogenicity for a fusosome is antibody response.

105. The fusosome of any of the preceding embodiments, wherein a subject that receives a fusosome described herein has pre-existing antibodies which bind to and recognize fusosome, e.g., measured as described herein, e.g., as described in Example 13.

106. The fusosome of any of the preceding embodiments, wherein serum from fusosome-naïve mice shows more signal (e.g., fluorescence) than the negative control, e.g., serum from a mouse depleted of IgM and IgG, e.g., indicating that in immunogenicity has occurred.

107. The fusosome of any of the preceding embodiments, wherein serum from fusosome-naïve mice shows similar signal (e.g., fluorescence) compared to the negative control, e.g., indicating that immunogenicity did not detectably occur.

108. The fusosome of any of the preceding embodiments, which is a modified fusosome, e.g., modified by a method described herein, and which has a reduced (e.g., reduced compared to administration of an unmodified fusosome) humoral response following multiple (e.g., more than one, e.g., 2 or more), administrations of the modified fusosome, e.g., measured as described herein, e.g., as described in Example 14.

109. The fusosome of any of the preceding embodiments, wherein the fusosome is produced by the methods of Example 5, 6, 7, or 14, e.g., from cells transfected with HLA-G or HLA-E cDNA.

110. The fusosome of any of the preceding embodiments, wherein humoral response is assessed by determining a value for the level of anti-fusosome antibodies (e.g., IgM, IgG1, and/or IgG2 antibodies).

111. The fusosome of any of the preceding embodiments, wherein modified (e.g., NMC-HLA-G) fusosomes have decreased anti-viral IgM or IgG1/2 antibody titers (e.g., as measured by fluorescence intensity on FACS) after injections, as compared to a control, e.g., NMC fusosomes or NMC-empty fusosomes.

112. The fusosome of any of the preceding embodiments, wherein recipient cells are not targeted by an antibody response, or an antibody response will be below a reference level, e.g., measured as described herein, e.g., as described in Example 15.

113. The fusosome of any of the preceding embodiments, signal (e.g., mean fluorescence intensity) is similar for recipient cells from mice treated with fusosomes and mice treated with PBS.

114. The fusosome of any of the preceding embodiments, wherein a measure of the immunogenicity of recipient cells is the macrophage response.

115. The fusosome of any of the preceding embodiments, wherein recipient cells are not targeted by macrophages, or are targeted below a reference level.

116. The fusosome of any of the preceding embodiments, wherein the phagocytic index, e.g., measured as described herein, e.g., as described in Example 16, is similar for recipient cells derived from mice treated with fusosomes and mice treated with PBS.

117. The fusosome of any of the preceding embodiments, wherein a measure of the immunogenicity of recipient cells is the PBMC response.

118. The fusosome of any of the preceding embodiments, wherein recipient cells do not elicit a PBMC response.

119. The fusosome of any of the preceding embodiments, wherein the percent of CD3+/CMG+ cells is similar for recipient cells derived from mice treated with fusosome and mice treated with PBS, e.g., as measured as described herein, e.g., as described in Example 17.

120. The fusosome of any of the preceding embodiments, wherein a measure of the immunogenicity of recipient cells is the natural killer cell response.

121. The fusosome of any of the preceding embodiments, wherein recipient cells do not elicit a natural killer cell response or elicit a lower natural killer cell response, e.g., lower than a reference value.

122. The fusosome of any of the preceding embodiments, wherein the percent of CD3+/CMG+ cells is similar for recipient cells derived from mice treated with fusosome and mice treated with PBS, e.g., as measured as described herein, e.g., as described in Example 18.

123. The fusosome of any of the preceding embodiments, wherein a measure of the immunogenicity of recipient cells is the CD8+ T cell response.

124. The fusosome of any of the preceding embodiments, wherein recipient cells do not elicit a CD8+ T cell response or elicit a lower CD8+ T cell response, e.g., lower than a reference value.

125. The fusosome of any of the preceding embodiments, wherein the percent of CD3+/CMG+ cells is similar for recipient cells derived from mice treated with fusosome and mice treated with PBS, e.g., as measured as described herein, e.g., as described in Example 19.

126. The fusosome of any of the preceding embodiments, wherein the fusogen is a re-targeted fusogen.

127. The fusosome of any of the preceding embodiments, which comprises a nucleic acid, e.g., retroviral nucleic acid, that encodes one or both of: (i) a positive target cell-specific regulatory element operatively linked to a nucleic acid encoding an exogenous agent, or (ii) a non-target cell-specific regulatory element or negative TCSRE operatively linked to the nucleic acid encoding the exogenous agent.

128. A pharmaceutical composition comprising the fusosome of any of the preceding embodiments, and a pharmaceutically acceptable carrier, diluent, or excipient.

129. A method of delivering an exogenous agent to a subject (e.g., a human subject) comprising administering to the subject a fusosome of any of embodiments 1-127, or the pharmaceutical composition of embodiment 128, thereby delivering the exogenous agent to the subject.

130. A method of modulating a function, in a subject (e.g., a human subject), target tissue or target cell (e.g., a T cell, e.g., a Treg cell), comprising contacting, e.g., administering to, the subject, the target tissue or the target cell a fusosome of any of embodiments 1-127, or the pharmaceutical composition of embodiment 128.

131. The method of embodiment 130, wherein the target tissue or the target cell is present in a subject.

132. A method of treating a disease or disorder in a subject (e.g., a human subject) comprising administering to the subject a fusosome of any of embodiments 1-127 or the pharmaceutical composition of embodiment 128.

133. The method of embodiment 132, wherein the disease or disorder is a disease or disorder of Table 5.

134. The method of embodiment 132 or embodiment 133, wherein the disease or disorder is able to be treated by the payload gene encoding the exogenous agent.

135. The method of any of embodiments 132-134, wherein the disease or disorder is selected from acute GvHD, alopecia areata, autoimmune uveitis, celiac disease, chronic GvHD, Crohn's disease, endometriosis, eosinophilic esophagitis, Grave's disease, Hashimoto's thyroiditis, multiple sclerosis, myasthenia gravis, pemphigoig, pemphigus, rheumatoid arthritis, solid organ transplant, systemic lupus erythmatosus, type 1 diabetes, ulcerative colitis.

136. A fusosome of any of embodiments 1-127 or pharmaceutical composition of embodiment 128 for use in treating a subject (e.g. a human subject) with a disease or disorder.

137. Use of a fusosome of any of embodiments 1-127 or pharmaceutical composition of embodiment 128 for manufacture of a medicament for use in treating a subject (e.g. a human subject) with a disease or disorder.

138. The fusosome or pharmaceutical composition for use of embodiment 137 or the use of embodiments 138, wherein the fusosome comprises a payload gene encoding an exogenous agent for treating the disease or disorder.

139. The fusosome or pharmaceutical composition for use of embodiment 136 or 138 or the use of embodiment 137 or 138, wherein the disease or disorder is selected from acute GvHD, alopecia areata, autoimmune uveitis, celiac disease, chronic GvHD, Crohn's disease, endometriosis, eosinophilic esophagitis, Grave's disease, Hashimoto's thyroiditis, multiple sclerosis, myasthenia gravis, pemphigoid, pemphigus, rheumatoid arthritis, solid organ transplant, systemic lupus erythmatosus, type 1 diabetes, ulcerative colitis.

140. A method of making a fusosome of any of embodiments 1-127, comprising:

a) providing a cell that comprises the nucleic acid, e.g., retroviral nucleic acid, and the fusogen;
b) culturing the cell under conditions that allow for production of the fusosome, and
c) separating, enriching, or purifying the fusosome from the cell, thereby making the fusosome.

Other features, objects, and advantages of the invention will be apparent from the description and drawings, and from the claims.

Unless otherwise defined, all technical and scientific terms used herein have the same meaning as commonly understood by one of ordinary skill in the art to which this invention belongs. All publications, patent applications, patents, and other references mentioned herein are incorporated by reference in their entirety. For example, all GenBank, Unigene, and Entrez sequences referred to herein, e.g., in any Table herein, are incorporated by reference. Unless otherwise specified, the sequence accession numbers specified herein, including in any Table herein, refer to the database entries current as of May 15, 2018. When one gene or protein references a plurality of sequence accession numbers, all of the sequence variants are encompassed. In addition, the materials, methods, and examples are illustrative only and not intended to be limiting.

BRIEF DESCRIPTION OF THE DRAWINGS

The following detailed description of the invention will be better understood when read in conjunction with the appended drawings. For the purpose of illustrating the invention, there are shown in the drawings described herein certain embodiments, which are presently exemplified. It should be understood, however, that the invention is not limited to the precise arrangement and instrumentalities of the embodiments shown in the drawings.

FIG. 3 is a table showing size distribution statistics of fusosomes and parental cells as measured by NTA and microscopy.

FIG. 4 is a table showing the average size and volume of fusosomes and parental cells.

FIG. 11 is a table showing delivery of Cre cargo by NivG+F fusosomes via a non-endocytic pathway.

DETAILED DESCRIPTION

Figure 1:
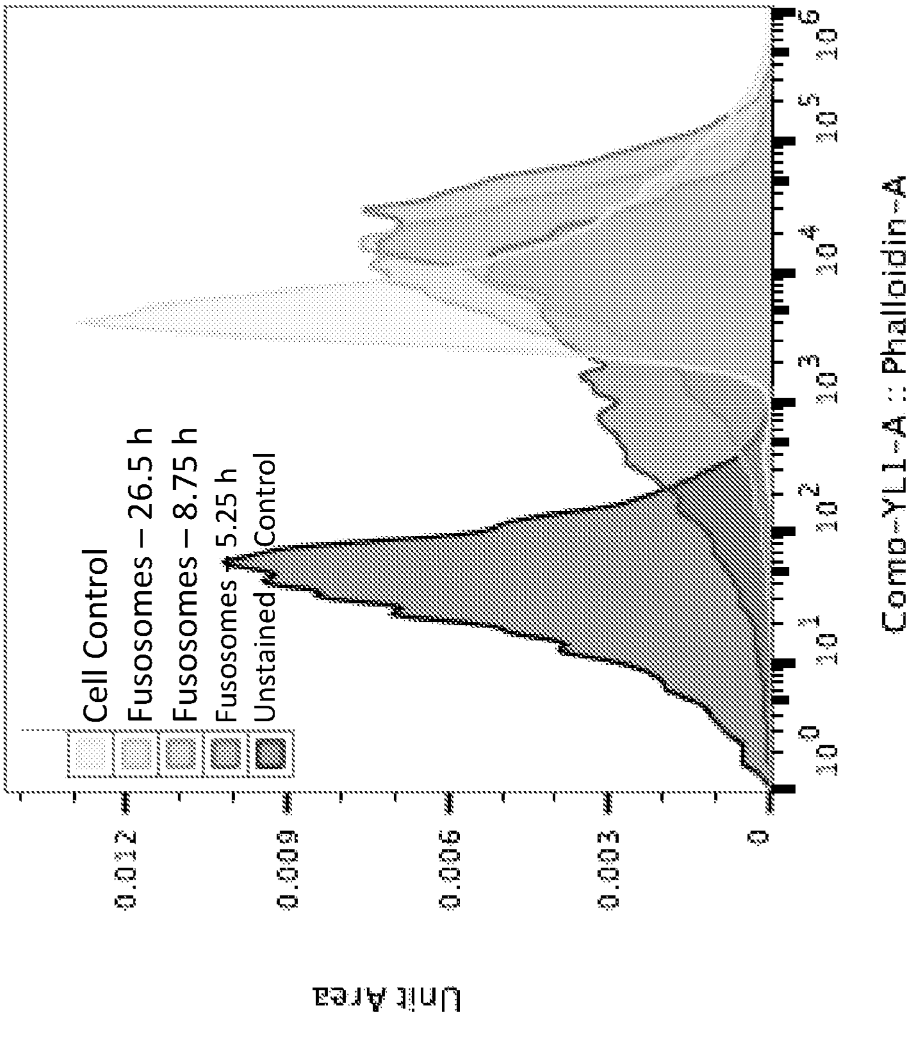
FIG. 1 quantifies staining of fusosomes with a dye for F-actin.

The present disclosure provides, at least in part, fusosome methods and compositions for in vivo delivery. In some embodiments, the fusosome comprises a combination of elements that promote specificity for target cells, e.g., one or more of a re-targeted fusogen, a positive target cell-specific regulatory element, and a non-target cell-specific regulatory element. In some embodiments, the fusosome comprises one or more modifications that decrease an immune response against the fusosome.

I. Definitions

Terms used in the claims and specification are defined as set forth below unless otherwise specified.

The term "antigen binding domain" as used herein refers to that portion of antibody or a chimeric antigen receptor which binds an antigen. In some embodiments, an antigen binding domain binds to a cell surface antigen of a cell. In some embodiments an antigen binding domain binds an antigen characteristic of a cancer, e.g., a tumor associated antigen in a neoplastic cell. In some embodiments, an antigen binding domain binds an antigen characteristic of an infectious disease, e.g. a virus associated antigen in a virus infected cell. In some embodiments, an antigen binding domain binds an antigen characteristic of a cell targeted by a subject's immune system in an autoimmune disease, e.g., a self-antigen. In some embodiments, an antigen binding domain is or comprises an antibody or antigen-binding portion thereof. In some embodiments, an antigen binding domain is or comprises an scFv or Fab.

The terms "cancer", "malignancy", "neoplasm", "tumor", and "carcinoma", are used herein to refer to cells that exhibit relatively abnormal, uncontrolled, and/or autonomous growth, so that they exhibit an aberrant growth phenotype characterized by a significant loss of control of cell proliferation. In some embodiments, a tumor may be or comprise cells that are precancerous (e.g., benign), malignant, pre-metastatic, metastatic, and/or non-metastatic. The present disclosure specifically identifies certain cancers to which its teachings may be particularly relevant. In some embodiments, a relevant cancer may be characterized by a solid tumor. In some embodiments, a tumor may be a disperse tumor or a liquid tumor. In some embodiments, a relevant cancer may be characterized by a hematologic tumor. In general, examples of different types of cancers known in the art include, for example, leukemias, lymphomas (Hodgkin's and non-Hodgkin's), myelomas and myeloproliferative disorders; sarcomas, melanomas, adenomas, carcinomas of solid tissue, squamous cell carcinomas of the mouth, throat, larynx, and lung, liver cancer, genitourinary cancers such as prostate, cervical, bladder, uterine, and endometrial cancer and renal cell carcinomas, bone cancer, pancreatic cancer, skin cancer, cutaneous or intraocular melanoma, cancer of the endocrine system, cancer of the thyroid gland, cancer of the parathyroid gland, head and neck cancers, breast cancer, gastro-intestinal cancers and nervous system cancers, benign lesions such as papillomas, and the like.

As used herein, "CDR" refers to a complementarity determining region, e.g., which can be situated within an antibody variable region. There are three CDRs in each of the variable regions of the heavy chain and the light chain, which are designated CDR1, CDR2 and CDR3, for each of the variable regions. A "set of CDRs" or "CDR set" refers to a group of three or six CDRs that occur in either a single variable region capable of binding the antigen or the CDRs of cognate heavy and light chain variable regions capable of binding the antigen. Certain systems have been established in the art for defining CDR boundaries (e.g., Kabat, Chothia, etc.); those skilled in the art appreciate the differences between and among these systems and are capable of understanding CDR boundaries to the extent required to understand and to practice the claimed invention.

As used herein, "detectably present", when used in the context of an exogenous agent being detectably present, means that the exogenous agent itself is detectably present. For instance, if the exogenous agent is a protein, the exogenous protein agent can be detectably present regardless of whether a nucleic acid that encodes it is detectably present or not.

As used herein, "fusosome" refers to a bilayer of amphipathic lipids enclosing a lumen or cavity and a fusogen that interacts with the amphipathic lipid bilayer. In embodiments, the fusosome comprises a nucleic acid. In some embodiments, the fusosome is a membrane enclosed preparation. In some embodiments, the fusosome is derived from a source cell.

As used herein, "fusosome composition" refers to a composition comprising one or more fusosomes.

As used herein, "fusogen" refers to an agent or molecule that creates an interaction between two membrane enclosed lumens. In embodiments, the fusogen facilitates fusion of the membranes. In other embodiments, the fusogen creates a connection, e.g., a pore, between two lumens (e.g., a lumen of a retroviral vector and a cytoplasm of a target cell). In some embodiments, the fusogen comprises a complex of two or more proteins, e.g., wherein neither protein has fusogenic activity alone. In some embodiments, the fusogen comprises a targeting domain.

As used herein, an "insulator element" refers to a nucleotide sequence that blocks enhancers or prevents heterochromatin spreading. An insulator element can be wild-type or mutant.

The term "effective amount" as used herein means an amount of a pharmaceutical composition which is sufficient enough to significantly and positively modify the symptoms and/or conditions to be treated (e.g., provide a positive clinical response). The effective amount of an active ingredient for use in a pharmaceutical composition will vary with the particular condition being treated, the severity of the condition, the duration of treatment, the nature of concurrent therapy, the particular active ingredient(s) being employed, the particular pharmaceutically-acceptable excipient(s) and/or carrier(s) utilized, and like factors with the knowledge and expertise of the attending physician.

An "exogenous agent" as used herein with reference to a virus, VLP or fusosome, refers to an agent that is neither comprised by nor encoded in the corresponding wild-type virus or fusogen made from a corresponding wild-type source cell. In some embodiments, the exogenous agent does not naturally exist, such as a protein or nucleic acid that has a sequence that is altered (e.g., by insertion, deletion, or substitution) relative to a naturally occurring protein. In some embodiments, the exogenous agent does not naturally exist in the source cell. In some embodiments, the exogenous agent exists naturally in the source cell but is exogenous to the virus. In some embodiments, the exogenous agent does not naturally exist in the recipient cell. In some embodiments, the exogenous agent exists naturally in the recipient cell, but is not present at a desired level or at a desired time. In some embodiments, the exogenous agent comprises RNA or protein.

The term "pharmaceutically acceptable" as used herein, refers to excipients, compositions and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein, a "promoter" refers to a cis-regulatory DNA sequence that, when operably linked to a gene coding sequence, drives transcription of the gene. The promoter may comprise a transcription factor binding sites. In some embodiments, a promoter works in concert with one or more enhancers which are distal to the gene.

As used herein, a "positive target cell-specific regulatory element" (or positive TCSRE) refers to a nucleic acid sequence that increases the level of an exogenous agent in a target cell compared to in a non-target cell, wherein the nucleic acid encoding the exogenous agent is operably linked to the positive TCSRE. In some embodiments, the positive TCSRE is a functional nucleic acid sequence, e.g., the positive TCSRE can comprise a promoter or enhancer. In some embodiments, the positive TCSRE encodes a functional RNA sequence, e.g., the positive TCSRE can encode a splice site that promotes correct splicing of the RNA in the target cell. In some embodiments, the positive TCSRE encodes a functional protein sequence, or the positive TCSRE can encode a protein sequence that promotes correct post-translational modification of the protein. In some embodiments, the positive TCSRE decreases the level or activity of a downregulator or inhibitor of the exogenous agent.

As used herein, a "negative target cell-specific regulatory element" (or negative TCSRE) refers to a nucleic acid sequence that decreases the level of an exogenous agent in a non-target cell compared to in a target cell, wherein the nucleic acid encoding the exogenous agent is operably linked to the negative TCSRE. In some embodiments, the negative TCSRE is a functional nucleic acid sequence, e.g., a miRNA recognition site that causes degradation or inhibition of the retroviral nucleic acid in a non-target cell. In some embodiments, the nucleic acid sequence encodes a functional RNA sequence, e.g., the nucleic acid encodes an miRNA sequence present in an mRNA encoding an exogenous protein agent, such that the mRNA is degraded or inhibited in a non-target cell. In some embodiments, the negative TCSRE increases the level or activity of a downregulator or inhibitor of the exogenous agent.

As used herein, a "non-target cell-specific regulatory element" (or NTCSRE) refers to a nucleic acid sequence that decreases the level of an exogenous agent in a non-target cell compared to in a target cell, wherein the nucleic acid encoding the exogenous agent is operably linked to the NTCSRE. In some embodiments, the NTCSRE is a functional nucleic acid sequence, e.g., a miRNA recognition site that causes degradation or inhibition of the retroviral nucleic acid in a non-target cell. In some embodiments, the nucleic acid sequence encodes a functional RNA sequence, e.g., the nucleic acid encodes an miRNA sequence present in an mRNA encoding an exogenous protein agent, such that the mRNA is degraded or inhibited in a non-target cell. In some embodiments, the NTCSRE increases the level or activity of a downregulator or inhibitor of the exogenous agent. The terms "negative TCSRE" and "NTCSRE" are used interchangeably herein.

As used herein, a "non-T cell specific regulatory element" refers to a non-target cell-specific regulatory element (NTCSRE), wherein the target cell is a T cell. Thus, a non-T cell specific regulatory element refers to a nucleic acid sequence that decreases the level of an exogenous agent in a non-T cell compared to in a T cell, wherein the nucleic acid encoding the exogenous agent is operably linked to the non-T cell-specific regulatory element.

As used herein, a "re-targeted fusogen" refers to a fusogen that comprises a targeting moiety having a sequence that is not part of the naturally-occurring form of the fusogen. In embodiments, the fusogen comprises a different targeting moiety relative to the targeting moiety in the naturally-occurring form of the fusogen. In embodiments, the naturally-occurring form of the fusogen lacks a targeting domain, and the re-targeted fusogen comprises a targeting moiety that is absent from the naturally-occurring form of the fusogen. In embodiments, the fusogen is modified to comprise a targeting moiety. In embodiments, the fusogen comprises one or more sequence alterations outside of the targeting moiety relative to the naturally-occurring form of the fusogen, e.g., in a transmembrane domain, fusogenically active domain, or cytoplasmic domain.

As used herein, a "retroviral nucleic acid" refers to a nucleic acid containing at least the minimal sequence requirements for packaging into a retrovirus or retroviral vector, alone or in combination with a helper cell, helper virus, or helper plasmid. In some embodiments, the retroviral nucleic acid further comprises or encodes an exogenous agent, a positive target cell-specific regulatory element, a non-target cell-specific regulatory element, or a negative TCSRE. In some embodiments, the retroviral nucleic acid comprises one or more of (e.g., all of) a 5' LTR (e.g., to promote integration), U3 (e.g., to activate viral genomic RNA transcription), R (e.g., a Tat-binding region), U5, a 3' LTR (e.g., to promote integration), a packaging site (e.g., psi (Ψ)), RRE (e.g., to bind to Rev and promote nuclear export). The retroviral nucleic acid can comprise RNA (e.g., when part of a virion) or DNA (e.g., when being introduced into a source cell or after reverse transcription in a recipient cell). In some embodiments, the retroviral nucleic acid is packaged using a helper cell, helper virus, or helper plasmid which comprises one or more of (e.g., all of) gag, pol, and env.

As used herein, a "target cell" refers to a cell of a type to which it is desired that a fusosome (e.g., lentiviral vector) deliver an exogenous agent. In embodiments, a target cell is a cell of a specific tissue type or class, e.g., a T cell, e.g., a Treg cell. In some embodiments, a target cell is a diseased cell, e.g., a cancer cell. In some embodiments, the fusogen, e.g., re-targeted fusogen (alone or in combination with the positive TCSRE, NTCSRE, negative TCSRE, or any combination thereof) leads to preferential delivery of the exogenous agent to a target cell compared to a non-target cell.

As used herein a "non-target cell" refers to a cell of a type to which it is not desired that a lentiviral vector delivers an exogenous agent. In some embodiments, a non-target cell is a cell of a specific tissue type or class. In some embodiments, a non-target cell is a non-diseased cell, e.g., a non-cancerous cell. In some embodiments, the fusogen, e.g., re-targeted fusogen (alone or in combination with the positive TCSRE, NTCSRE, negative TCSRE or any combination thereof) leads to lower delivery of the exogenous agent to a non-target cell compared to a target cell.

As used herein, the terms "treat," "treating," or "treatment" refer to ameliorating a disease or disorder, e.g., slowing or arresting or reducing the development of the disease or disorder, e.g., a root cause of the disorder or at least one of the clinical symptoms thereof.

As used herein, "cytobiologic" refers to a portion of a cell that comprises a lumen and a cell membrane, or a cell having partial or complete nuclear inactivation. In some embodiments, the cytobiologic comprises one or more of a cytoskeleton component, an organelle, and a ribosome. In embodiments, the cytobiologic is an enucleated cell, a microvesicle, or a cell ghost.

II. Fusosomes, e.g., Cell-Derived Fusosomes

Fusosomes can take various forms. For example, in some embodiments, a fusosome described herein is derived from a source cell. A fusosome may be or comprise, e.g., an extracellular vesicle, a microvesicle, a nanovesicle, an exosome, an apoptotic body (from apoptotic cells), a microparticle (which may be derived from, e.g., platelets), an ectosome (derivable from, e.g., neutrophiles and monocytes in serum), a prostatosome (obtainable from prostate cancer cells), a cardiosome (derivable from cardiac cells), or any combination thereof. In some embodiments, a fusosome is released naturally from a source cell, and in some embodiments, the source cell is treated to enhance formation of fusosomes. In some embodiments, the fusosome is between about 10-10,000 nm in diameter, e.g., about 30-100 nm in diameter. In some embodiments, the fusosome comprises one or more synthetic lipids.

In some embodiments, the fusosome is or comprises a virus, e.g., a retrovirus, e.g., a lentivirus. For instance, in some embodiments, the fusosome's bilayer of amphipathic lipids is or comprises the viral envelope. The viral envelope may comprise a fusogen, e.g., a fusogen that is endogenous to the virus or a pseudotyped fusogen. In some embodiments, the fusosome's lumen or cavity comprises a viral nucleic acid, e.g., a retroviral nucleic acid, e.g., a lentiviral nucleic acid. The viral nucleic acid may be a viral genome. In some embodiments, the fusosome further comprises one or more viral non-structural proteins, e.g., in its cavity or lumen.

Fusosomes may have various properties that facilitate delivery of a payload to a target cell. For instance, in some embodiments, the fusosome and the source cell together comprise nucleic acid(s) sufficient to make a particle that can fuse with a target cell. In embodiments, these nucleic acid(s) encode proteins having one or more of (e.g., all of) the following activities: gag polyprotein activity, polymerase activity, integrase activity, protease activity, and fusogen activity.

Fusosomes may also comprise various structures that facilitate delivery of a payload to a target cell. For instance, in some embodiments, the fusosome and the source cell together comprise nucleic acid(s) sufficient to make a particle that can fuse with a target cell. In embodiments, these nucleic acid(s) encode proteins having one or more of (e.g., all of) the following activities: gag polyprotein activity, polymerase activity, integrase activity, protease activity, and fusogen activity.

Fusosomes may also comprise various structures that facilitate delivery of a payload to a target cell. For instance, in some embodiments, the fusosome (e.g., virus, e.g., retrovirus, e.g., lentivirus) comprises one or more of (e.g., all of) the following proteins: gag polyprotein, polymerase (e.g., pol), integrase (e.g., a functional or non-functional variant), protease, and a fusogen. In some embodiments, the fusosome further comprises rev. In some embodiments, one or more of the aforesaid proteins are encoded in the retroviral genome, and in some embodiments, one or more of the aforesaid proteins are provided in trans, e.g., by a helper cell, helper virus, or helper plasmid. In some embodiments, the fusosome nucleic acid (e.g., retroviral nucleic acid) comprises one or more of (e.g., all of) the following nucleic acid sequences: 5' LTR (e.g., comprising U5 and lacking a functional U3 domain), Psi packaging element (Psi), Central polypurine tract (cPPT) Promoter operatively linked to the payload gene, payload gene (optionally comprising an intron before the open reading frame), Poly A tail sequence, WPRE, and 3' LTR (e.g., comprising U5 and lacking a functional U3). In some embodiments the fusosome nucleic acid (e.g., retroviral nucleic acid) further comprises one or more insulator element. In some embodiments the fusosome nucleic acid (e.g., retroviral nucleic acid) further comprises one or more miRNA recognition sites. In some embodiments, one or more of the miRNA recognition sites are situated downstream of the poly A tail sequence, e.g., between the poly A tail sequence and the WPRE.

In some embodiments, a fusosome provided herein is administered to a subject, e.g., a mammal, e.g., a human. In such embodiments, the subject may be at risk of, may have a symptom of, or may be diagnosed with or identified as having, a particular disease or condition (e.g., a disease or condition described herein). In one embodiment, the subject has a disease or disorder, such as any listed in Table 5. In some embodiments, the fusosome contains nucleic acid sequences encoding an exogenous agent for treating the disease or condition, such as for treating the disease or disorder.

A. Fusosomes Generated from Viruses.

For instance, in some embodiments, the fusosome (e.g., virus, e.g., retrovirus, e.g., lentivirus) comprises one or more of (e.g., all of) the following proteins: gag polyprotein, polymerase (e.g., pol), integrase (e.g., a functional or non-functional variant), protease, and a fusogen. In some embodiments, the fusosome further comprises rev. In some embodiments, one or more of the aforesaid proteins are encoded in the retroviral genome, and in some embodiments, one or more of the aforesaid proteins are provided in trans, e.g., by a helper cell, helper virus, or helper plasmid. In some embodiments, the fusosome nucleic acid (e.g., retroviral nucleic acid) comprises one or more of (e.g., all of) the following nucleic acid sequences: 5' LTR (e.g., comprising U5 and lacking a functional U3 domain), Psi packaging element (Psi), Central polypurine tract (cPPT) Promoter operatively linked to the payload gene, payload gene (optionally comprising an intron before the open reading frame), Poly A tail sequence, WPRE, and 3' LTR (e.g., comprising U5 and lacking a functional U3). In some embodiments the fusosome nucleic acid (e.g., retroviral nucleic acid) further comprises one or more insulator element. In some embodiments the fusosome nucleic acid (e.g., retroviral nucleic acid) further comprises one or more miRNA recognition sites. In some embodiments, one or more of the miRNA recognition sites are situated downstream of the poly A tail sequence, e.g., between the poly A tail sequence and the WPRE.

i) Lentiviral Components and Helper Cells

In some embodiments, the retroviral nucleic acid comprises one or more of (e.g., all of): a 5' promoter (e.g., to control expression of the entire packaged RNA), a 5' LTR (e.g., that includes R (polyadenylation tail signal) and/or U5 which includes a primer activation signal), a primer binding site, a psi packaging signal, a RRE element for nuclear export, a promoter directly upstream of the transgene to control transgene expression, a transgene (or other exogenous agent element), a polypurine tract, and a 3' LTR (e.g., that includes a mutated U3, a R, and U5). In some embodiments, the retroviral nucleic acid further comprises one or more of a cPPT, a WPRE, and/or an insulator element.

A retrovirus typically replicates by reverse transcription of its genomic RNA into a linear double-stranded DNA copy and subsequently covalently integrates its genomic DNA into a host genome. Illustrative retroviruses suitable for use in particular embodiments, include, but are not limited to: Moloney murine leukemia virus (M-MuLV), Moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV) and Rous Sarcoma Virus (RSV)) and lentivirus.

In some embodiments the retrovirus is a Gammretrovirus. In some embodiments the retrovirus is an Epsilonretrovirus. In some embodiments the retrovirus is an Alpharetrovirus. In some embodiments the retrovirus is a Betaretrovirus. In some embodiments the retrovirus is a Deltaretrovirus. In some embodiments the retrovirus is a Lentivirus. In some embodiments the retrovirus is a Spumaretrovirus. In some embodiments the retrovirus is an endogenous retrovirus.

Illustrative lentiviruses include, but are not limited to: HIV (human immunodeficiency virus; including HIV type 1, and HIV type 2); visna-maedi virus (VMV) virus; the caprine arthritis-encephalitis virus (CAEV); equine infectious anemia virus (EIAV); feline immunodeficiency virus (FIV); bovine immune deficiency virus (BIV); and simian immunodeficiency virus (SIV). In some embodiments, HIV based vector backbones (i.e., HIV cis-acting sequence elements) are used.

In some embodiments, a vector herein is a nucleic acid molecule capable transferring or transporting another nucleic acid molecule. The transferred nucleic acid is generally linked to, e.g., inserted into, the vector nucleic acid molecule. A vector may include sequences that direct autonomous replication in a cell, or may include sequences sufficient to allow integration into host cell DNA. Useful vectors include, for example, plasmids (e.g., DNA plasmids or RNA plasmids), transposons, cosmids, bacterial artificial chromosomes, and viral vectors. Useful viral vectors include, e.g., replication defective retroviruses and lentiviruses.

A viral vector can comprise, e.g., a nucleic acid molecule (e.g., a transfer plasmid) that includes virus-derived nucleic acid elements that typically facilitate transfer of the nucleic acid molecule or integration into the genome of a cell or to a viral particle that mediates nucleic acid transfer. Viral particles will typically include various viral components and sometimes also host cell components in addition to nucleic acid(s). A viral vector can comprise, e.g., a virus or viral particle capable of transferring a nucleic acid into a cell, or to the transferred nucleic acid (e.g., as naked DNA). Viral vectors and transfer plasmids can comprise structural and/or functional genetic elements that are primarily derived from a virus. A retroviral vector can comprise a viral vector or plasmid containing structural and functional genetic elements, or portions thereof, that are primarily derived from a retrovirus. A lentiviral vector can comprise a viral vector or plasmid containing structural and functional genetic elements, or portions thereof, including LTRs that are primarily derived from a lentivirus.

In embodiments, a lentiviral vector (e.g., lentiviral expression vector) may comprise a lentiviral transfer plasmid (e.g., as naked DNA) or an infectious lentiviral particle. With respect to elements such as cloning sites, promoters, regulatory elements, heterologous nucleic acids, etc., it is to be understood that the sequences of these elements can be present in RNA form in lentiviral particles and can be present in DNA form in DNA plasmids.

In some vectors described herein, at least part of one or more protein coding regions that contribute to or are essential for replication may be absent compared to the corresponding wild-type virus. This makes the viral vector replication-defective. In some embodiments, the vector is capable of transducing a target non-dividing host cell and/or integrating its genome into a host genome.

The structure of a wild-type retrovirus genome often comprises a 5' long terminal repeat (LTR) and a 3' LTR, between or within which are located a packaging signal to enable the genome to be packaged, a primer binding site, integration sites to enable integration into a host cell genome and gag, pol and env genes encoding the packaging components which promote the assembly of viral particles. More complex retroviruses have additional features, such as rev and RRE sequences in HIV, which enable the efficient export of RNA transcripts of the integrated provirus from the nucleus to the cytoplasm of an infected target cell. In the provirus, the viral genes are flanked at both ends by regions called long terminal repeats (LTRs). The LTRs are involved in proviral integration and transcription. LTRs also serve as enhancer-promoter sequences and can control the expression of the viral genes. Encapsidation of the retroviral RNAs occurs by virtue of a psi sequence located at the 5' end of the viral genome.

The LTRs themselves are typically similar (e.g., identical) sequences that can be divided into three elements, which are called U3, R and U5. U3 is derived from the sequence unique to the 3' end of the RNA. R is derived from a sequence repeated at both ends of the RNA and U5 is derived from the sequence unique to the 5' end of the RNA. The sizes of the three elements can vary considerably among different retroviruses.

For the viral genome, the site of transcription initiation is typically at the boundary between U3 and R in one LTR and the site of poly (A) addition (termination) is at the boundary between R and U5 in the other LTR. U3 contains most of the transcriptional control elements of the provirus, which include the promoter and multiple enhancer sequences responsive to cellular and in some cases, viral transcriptional activator proteins. Some retroviruses comprise any one or more of the following genes that code for proteins that are involved in the regulation of gene expression: tot, rev, tax and rex.

With regard to the structural genes gag, pol and env themselves, gag encodes the internal structural protein of the virus. Gag protein is proteolytically processed into the mature proteins MA (matrix), CA (capsid) and NC (nucleocapsid). The pol gene encodes the reverse transcriptase (RT), which contains DNA polymerase, associated RNase H and integrase (IN), which mediate replication of the genome. The env gene encodes the surface (SU) glycoprotein and the transmembrane (TM) protein of the virion, which form a complex that interacts specifically with cellular receptor proteins. This interaction promotes infection, e.g., by fusion of the viral membrane with the cell membrane.

In a replication-defective retroviral vector genome gag, pol and env may be absent or not functional. The R regions at both ends of the RNA are typically repeated sequences. U5 and U3 represent unique sequences at the 5' and 3' ends of the RNA genome respectively.

Retroviruses may also contain additional genes which code for proteins other than gag, pol and env. Examples of additional genes include (in HIV), one or more of vif, vpr, vpx, vpu, tat, rev and nef. EIAV has (amongst others) the additional gene S2. Proteins encoded by additional genes serve various functions, some of which may be duplicative of a function provided by a cellular protein. In EIAV, for example, tat acts as a transcriptional activator of the viral LTR (Derse and Newbold 1993 Virology 194:530-6; Maury et al. 1994 Virology 200:632-42). It binds to a stable, stem-loop RNA secondary structure referred to as TAR. Rev regulates and co-ordinates the expression of viral genes through rev-response elements (RRE) (Martarano et al. 1994 J. Virol. 68:3102-11). The mechanisms of action of these two proteins are thought to be broadly similar to the analogous mechanisms in the primate viruses. In addition, an EIAV protein, Ttm, has been identified that is encoded by the first exon of tat spliced to the env coding sequence at the start of the transmembrane protein.

In addition to protease, reverse transcriptase and integrase, non-primate lentiviruses contain a fourth pol gene product which codes for a dUTPase. This may play a role in the ability of these lentiviruses to infect certain non-dividing or slowly dividing cell types.

In embodiments, a recombinant lentiviral vector (RLV) is a vector with sufficient retroviral genetic information to allow packaging of an RNA genome, in the presence of packaging components, into a viral particle capable of infecting a target cell. Infection of the target cell can comprise reverse transcription and integration into the target cell genome. The RLV typically carries non-viral coding sequences which are to be delivered by the vector to the target cell. In embodiments, an RLV is incapable of independent replication to produce infectious retroviral particles within the target cell. Usually the RLV lacks a functional gag-pol and/or env gene and/or other genes involved in replication. The vector may be configured as a split-intron vector, e.g., as described in PCT patent application WO 99/15683, which is herein incorporated by reference in its entirety.

In some embodiments, the lentiviral vector comprises a minimal viral genome, e.g., the viral vector has been manipulated so as to remove the non-essential elements and to retain the essential elements in order to provide the required functionality to infect, transduce and deliver a nucleotide sequence of interest to a target host cell, e.g., as described in WO 98/17815, which is herein incorporated by reference in its entirety.

A minimal lentiviral genome may comprise, e.g., (5') R-U5-one or more first nucleotide sequences-U3-R(3'). However, the plasmid vector used to produce the lentiviral genome within a source cell can also include transcriptional regulatory control sequences operably linked to the lentiviral genome to direct transcription of the genome in a source cell. These regulatory sequences may comprise the natural sequences associated with the transcribed retroviral sequence, e.g., the 5' U3 region, or they may comprise a heterologous promoter such as another viral promoter, for example the CMV promoter. Some lentiviral genomes comprise additional sequences to promote efficient virus production. For example, in the case of HIV, rev and RRE sequences may be included. Alternatively or combination, codon optimization may be used, e.g., the gene encoding the exogenous agent may be codon optimized, e.g., as described in WO 01/79518, which is herein incorporated by reference in its entirety. Alternative sequences which perform a similar or the same function as the rev/RRE system may also be used. For example, a functional analogue of the rev/RRE system is found in the Mason Pfizer monkey virus. This is known as CTE and comprises an RRE-type sequence in the genome which is believed to interact with a factor in the infected cell. The cellular factor can be thought of as a rev analogue. Thus, CTE may be used as an alternative to the rev/RRE system. In addition, the Rex protein of HTLV-I can functionally replace the Rev protein of HIV-I. Rev and Rex have similar effects to IRE-BP.

In some embodiments, a retroviral nucleic acid (e.g., a lentiviral nucleic acid, e.g., a primate or non-primate lentiviral nucleic acid) (1) comprises a deleted gag gene wherein the deletion in gag removes one or more nucleotides downstream of about nucleotide 350 or 354 of the gag coding sequence; (2) has one or more accessory genes absent from the retroviral nucleic acid; (3) lacks the tat gene but includes the leader sequence between the end of the 5' LTR and the ATG of gag; and (4) combinations of (1), (2) and (3). In an embodiment the lentiviral vector comprises all of features (1) and (2) and (3). This strategy is described in more detail in WO 99/32646, which is herein incorporated by reference in its entirety.

In some embodiments, a primate lentivirus minimal system requires none of the HIV/SIV additional genes vif, vpr, vpx, vpu, tat, rev and nef for either vector production or for transduction of dividing and non-dividing cells. In some embodiments, an EIAV minimal vector system does not require S2 for either vector production or for transduction of dividing and non-dividing cells.

The deletion of additional genes may permit vectors to be produced without the genes associated with disease in lentiviral (e.g. HIV) infections. In particular, tat is associated with disease. Secondly, the deletion of additional genes permits the vector to package more heterologous DNA. Thirdly, genes whose function is unknown, such as S2, may be omitted, thus reducing the risk of causing undesired effects. Examples of minimal lentiviral vectors are disclosed in WO 99/32646 and in WO 98/17815.

In some embodiments, the retroviral nucleic acid is devoid of at least tat and S2 (if it is an EIAV vector system), and possibly also vif, vpr, vpx, vpu and nef. In some embodiments, the retroviral nucleic acid is also devoid of rev, RRE, or both.

In some embodiments the retroviral nucleic acid comprises vpx. The Vpx polypeptide binds to and induces the degradation of the SAMHD1 restriction factor, which degrades free dNTPs in the cytoplasm. Thus, the concentration of free dNTPs in the cytoplasm increases as Vpx degrades SAMHD1 and reverse transcription activity is increased, thus facilitating reverse transcription of the retroviral genome and integration into the target cell genome.

Different cells differ in their usage of particular codons. This codon bias corresponds to a bias in the relative abundance of particular tRNAs in the cell type. By altering the codons in the sequence so that they are tailored to match with the relative abundance of corresponding tRNAs, it is possible to increase expression. By the same token, it is possible to decrease expression by deliberately choosing codons for which the corresponding tRNAs are known to be rare in the particular cell type. Thus, an additional degree of translational control is available. An additional description of codon optimization is found, e.g., in WO 99/41397, which is herein incorporated by reference in its entirety.

Many viruses, including HIV and other lentiviruses, use a large number of rare codons and by changing these to correspond to commonly used mammalian codons, increased expression of the packaging components in mammalian producer cells can be achieved.

Codon optimization has a number of other advantages. By virtue of alterations in their sequences, the nucleotide sequences encoding the packaging components may have RNA instability sequences (INS) reduced or eliminated from them. At the same time, the amino acid sequence coding sequence for the packaging components is retained so that the viral components encoded by the sequences remain the same, or at least sufficiently similar that the function of the packaging components is not compromised. In some embodiments, codon optimization also overcomes the Rev/RRE requirement for export, rendering optimized sequences Rev independent. In some embodiments, codon optimization also reduces homologous recombination between different constructs within the vector system (for example between the regions of overlap in the gag-pol and env open reading frames). In some embodiments, codon optimization leads to an increase in viral titer and/or improved safety.

In some embodiments, only codons relating to INS are codon optimized. In other embodiments, the sequences are codon optimized in their entirety, with the exception of the sequence encompassing the frameshift site of gag-pol.

The gag-pol gene comprises two overlapping reading frames encoding the gag-pol proteins. The expression of both proteins depends on a frameshift during translation. This frameshift occurs as a result of ribosome "slippage" during translation. This slippage is thought to be caused at least in part by ribosome-stalling RNA secondary structures. Such secondary structures exist downstream of the frameshift site in the gag-pol gene. For HIV, the region of overlap extends from nucleotide 1222 downstream of the beginning of gag (wherein nucleotide 1 is the A of the gag ATG) to the end of gag (nt 1503). Consequently, a 281 bp fragment spanning the frameshift site and the overlapping region of the two reading frames is preferably not codon optimized. In some embodiments, retaining this fragment will enable more efficient expression of the gag-pol proteins. For EIAV, the beginning of the overlap is at nt 1262 (where nucleotide 1 is the A of the gag ATG). The end of the overlap is at nt 1461. In order to ensure that the frameshift site and the gag-pol overlap are preserved, the wild type sequence may be retained from nt 1156 to 1465.

Derivations from optimal codon usage may be made, for example, in order to accommodate convenient restriction sites, and conservative amino acid changes may be introduced into the gag-pol proteins.

In some embodiments, codon optimization is based on codons with poor codon usage in mammalian systems. The third and sometimes the second and third base may be changed.

Due to the degenerate nature of the genetic code, it will be appreciated that numerous gag-pol sequences can be achieved by a skilled worker. Also, there are many retroviral variants described which can be used as a starting point for generating a codon optimized gag-pol sequence. Lentiviral genomes can be quite variable. For example there are many quasi-species of HIV-I which are still functional. This is also the case for EIAV. These variants may be used to enhance particular parts of the transduction process. Examples of HIV-I variants may be found in the HIV databases maintained by Los Alamos National Laboratory. Details of EIAV clones may be found at the NCBI database maintained by the National Institutes of Health.

The strategy for codon optimized gag-pol sequences can be used in relation to any retrovirus, e.g., EIAV, FIV, BIV, CAEV, VMR, SIV, HIV—I and HIV-2. In addition this method could be used to increase expression of genes from HTLV-I, HTLV-2, HFV, HSRV and human endogenous retroviruses (HERV), MLV and other retroviruses.

As described above, the packaging components for a retroviral vector can include expression products of gag, pol and env genes. In addition, packaging can utilize a short sequence of 4 stem loops followed by a partial sequence from gag and env as a packaging signal. Thus, inclusion of a deleted gag sequence in the retroviral vector genome (in addition to the full gag sequence on the packaging construct) can be used. In embodiments, the retroviral vector comprises a packaging signal that comprises from 255 to 360 nucleotides of gag in vectors that still retain env sequences, or about 40 nucleotides of gag in a particular combination of splice donor mutation, gag and env deletions. In some embodiments, the retroviral vector includes a gag sequence which comprises one or more deletions, e.g., the gag sequence comprises about 360 nucleotides derivable from the N-terminus.

The retroviral vector, helper cell, helper virus, or helper plasmid may comprise retroviral structural and accessory proteins, for example gag, pol, env, tat, rev, vif, vpr, vpu, vpx, or nef proteins or other retroviral proteins. In some embodiments the retroviral proteins are derived from the same retrovirus. In some embodiments the retroviral proteins are derived from more than one retrovirus, e.g. 2, 3, 4, or more retroviruses.

The gag and pol coding sequences are generally organized as the Gag-Pol Precursor in native lentivirus. The gag sequence codes for a 55-kD Gag precursor protein, also called p55. The p55 is cleaved by the virally encoded protease4 (a product of the pol gene) during the process of maturation into four smaller proteins designated MA (matrix [p17]), CA (capsid [p24]), NC (nucleocapsid [p9]), and p6. The pol precursor protein is cleaved away from Gag by a virally encoded protease, and further digested to separate the protease (p10), RT (p50), RNase H (p15), and integrase (p31) activities.

Native Gag-Pol sequences can be utilized in a helper vector (e.g., helper plasmid or helper virus), or modifications can be made. These modifications include, chimeric Gag-Pol, where the Gag and Pol sequences are obtained from different viruses (e.g., different species, subspecies, strains, clades, etc.), and/or where the sequences have been modified to improve transcription and/or translation, and/or reduce recombination.

In various examples, the retroviral nucleic acid includes a polynucleotide encoding a 150-250 (e.g., 168) nucleotide portion of a gag protein that (i) includes a mutated INS1 inhibitory sequence that reduces restriction of nuclear export of RNA relative to wild-type INS1, (ii) contains two nucleotide insertion that results in frame shift and premature termination, and/or (iii) does not include INS2, INS3, and INS4 inhibitory sequences of gag.

In some embodiments, a vector described herein is a hybrid vector that comprises both retroviral (e.g., lentiviral) sequences and non-lentiviral viral sequences. In some embodiments, a hybrid vector comprises retroviral e.g., lentiviral, sequences for reverse transcription, replication, integration and/or packaging.

According to certain specific embodiments, most or all of the viral vector backbone sequences are derived from a lentivirus, e.g., HIV-1. However, it is to be understood that many different sources of retroviral and/or lentiviral sequences can be used, or combined and numerous substitutions and alterations in certain of the lentiviral sequences may be accommodated without impairing the ability of a transfer vector to perform the functions described herein. A variety of lentiviral vectors are described in Naldini et al., (1996a, 1996b, and 1998); Zufferey et al., (1997); Dull et al., 1998, U.S. Pat. Nos. 6,013,516; and 5,994,136, many of which may be adapted to produce a retroviral nucleic acid.

At each end of the provirus, long terminal repeats (LTRs) are typically found. An LTR typically comprises a domain located at the ends of retroviral nucleic acid which, in their natural sequence context, are direct repeats and contain U3, R and U5 regions. LTRs generally promote the expression of retroviral genes (e.g., promotion, initiation and polyadenylation of gene transcripts) and viral replication. The LTR can comprise numerous regulatory signals including transcriptional control elements, polyadenylation signals and sequences for replication and integration of the viral genome. The viral LTR is typically divided into three regions called U3, R and U5. The U3 region typically contains the enhancer and promoter elements. The U5 region is typically the sequence between the primer binding site and the R region and can contain the polyadenylation sequence. The R (repeat) region can be flanked by the U3 and U5 regions. The LTR is typically composed of U3, R and U5 regions and can appear at both the 5' and 3' ends of the viral genome. In some embodiments, adjacent to the 5' LTR are sequences for reverse transcription of the genome (the tRNA primer binding site) and for efficient packaging of viral RNA into particles (the Psi site).

A packaging signal can comprise a sequence located within the retroviral genome which mediate insertion of the viral RNA into the viral capsid or particle, see e.g., Clever et al., 1995. J. of Virology, Vol. 69, No. 4; pp. 2101-2109. Several retroviral vectors use a minimal packaging signal (a psi [ψ] sequence) for encapsidation of the viral genome.

In various embodiments, retroviral nucleic acids comprise modified 5' LTR and/or 3' LTRs. Either or both of the LTR may comprise one or more modifications including, but not limited to, one or more deletions, insertions, or substitutions. Modifications of the 3' LTR are often made to improve the safety of lentiviral or retroviral systems by rendering viruses replication-defective, e.g., virus that is not capable of complete, effective replication such that infective virions are not produced (e.g., replication-defective lentiviral progeny).

In some embodiments, a vector is a self-inactivating (SIN) vector, e.g., replication-defective vector, e.g., retroviral or lentiviral vector, in which the right (3') LTR enhancer-promoter region, known as the U3 region, has been modified (e.g., by deletion or substitution) to prevent viral transcription beyond the first round of viral replication. This is because the right (3') LTR U3 region can be used as a template for the left (5') LTR U3 region during viral replication and, thus, absence of the U3 enhancer-promoter inhibits viral replication. In embodiments, the 3' LTR is modified such that the U5 region is removed, altered, or replaced, for example, with an exogenous poly (A) sequence The 3' LTR, the 5' LTR, or both 3' and 5' LTRs, may be modified LTRs.

In some embodiments, the U3 region of the 5' LTR is replaced with a heterologous promoter to drive transcription of the viral genome during production of viral particles. Examples of heterologous promoters which can be used include, for example, viral simian virus 40 (SV40) (e.g., early or late), cytomegalovirus (CMV) (e.g., immediate early), Moloney murine leukemia virus (MoMLV), Rous sarcoma virus (RSV), and herpes simplex virus (HSV) (thymidine kinase) promoters. In some embodiments, promoters are able to drive high levels of transcription in a Tat-independent manner. In certain embodiments, the heterologous promoter has additional advantages in controlling the manner in which the viral genome is transcribed. For example, the heterologous promoter can be inducible, such that transcription of all or part of the viral genome will occur only when the induction factors are present. Induction factors include, but are not limited to, one or more chemical compounds or the physiological conditions such as temperature or pH, in which the host cells are cultured.

In some embodiments, viral vectors comprise a TAR (trans-activation response) element, e.g., located in the R region of lentiviral (e.g., HIV) LTRs. This element interacts with the lentiviral trans-activator (tat) genetic element to enhance viral replication. However, this element is not required, e.g., in embodiments wherein the U3 region of the 5' LTR is replaced by a heterologous promoter.

The R region, e.g., the region within retroviral LTRs beginning at the start of the capping group (i.e., the start of transcription) and ending immediately prior to the start of the poly A tract can be flanked by the U3 and U5 regions. The R region plays a role during reverse transcription in the transfer of nascent DNA from one end of the genome to the other.

The retroviral nucleic acid can also comprise a FLAP element, e.g., a nucleic acid whose sequence includes the central polypurine tract and central termination sequences (cPPT and CTS) of a retrovirus, e.g., HIV-1 or HIV-2. Suitable FLAP elements are described in U.S. Pat. No.

6,682,907 and in Zennou, et al., 2000, Cell, 101:173, which are herein incorporated by reference in their entireties. During HIV-1 reverse transcription, central initiation of the plus-strand DNA at the central polypurine tract (cPPT) and central termination at the central termination sequence (CTS) can lead to the formation of a three-stranded DNA structure: the HIV-1 central DNA flap. In some embodiments, the retroviral or lentiviral vector backbones comprise one or more FLAP elements upstream or downstream of the gene encoding the exogenous agent. For example, in some embodiments a transfer plasmid includes a FLAP element, e.g., a FLAP element derived or isolated from HIV-1.

In embodiments, a retroviral or lentiviral nucleic acid comprises one or more export elements, e.g., a cis-acting post-transcriptional regulatory element which regulates the transport of an RNA transcript from the nucleus to the cytoplasm of a cell. Examples of RNA export elements include, but are not limited to, the human immunodeficiency virus (HIV) rev response element (RRE) (see e.g., Cullen et al., 1991. J. Virol. 65:1053; and Cullen et al., 1991. Cell 58:423), and the hepatitis B virus post-transcriptional regulatory element (HPRE), which are herein incorporated by reference in their entireties. Generally, the RNA export element is placed within the 3' UTR of a gene, and can be inserted as one or multiple copies.

In some embodiments, expression of heterologous sequences in viral vectors is increased by incorporating one or more of, e.g., all of, posttranscriptional regulatory elements, polyadenylation sites, and transcription termination signals into the vectors. A variety of posttranscriptional regulatory elements can increase expression of a heterologous nucleic acid at the protein, e.g., woodchuck hepatitis virus posttranscriptional regulatory element (WPRE; Zufferey et al., 1999, J. Virol., 73:2886); the posttranscriptional regulatory element present in hepatitis B virus (HPRE) (Huang et al., Mol. Cell. Biol., 5:3864); and the like (Liu et al., 1995, Genes Dev., 9:1766), each of which is herein incorporated by reference in its entirety. In some embodiments, a retroviral nucleic acid described herein comprises a posttranscriptional regulatory element such as a WPRE or HPRE In some embodiments, a retroviral nucleic acid described herein lacks or does not comprise a posttranscriptional regulatory element such as a WPRE or HPRE.

Elements directing the termination and polyadenylation of the heterologous nucleic acid transcripts may be included, e.g., to increases expression of the exogenous agent. Transcription termination signals may be found downstream of the polyadenylation signal. In some embodiments, vectors comprise a polyadenylation sequence 3' of a polynucleotide encoding the exogenous agent. A polyA site may comprise a DNA sequence which directs both the termination and polyadenylation of the nascent RNA transcript by RNA polymerase II. Polyadenylation sequences can promote mRNA stability by addition of a polyA tail to the 3' end of the coding sequence and thus, contribute to increased translational efficiency. Illustrative examples of polyA signals that can be used in a retroviral nucleic acid, include AATAAA, ATTAAA, AGTAAA, a bovine growth hormone polyA sequence (BGHpA), a rabbit β-globin polyA sequence (rβgpA), or another suitable heterologous or endogenous polyA sequence.

In some embodiments, a retroviral or lentiviral vector further comprises one or more insulator elements, e.g., an insulator element described herein.

In various embodiments, the vectors comprise a promoter operably linked to a polynucleotide encoding an exogenous agent. The vectors may have one or more LTRs, wherein either LTR comprises one or more modifications, such as one or more nucleotide substitutions, additions, or deletions. The vectors may further comprise one of more accessory elements to increase transduction efficiency (e.g., a cPPT/FLAP), viral packaging (e.g., a Psi (ψ) packaging signal, RRE), and/or other elements that increase exogenous gene expression (e.g., poly (A) sequences), and may optionally comprise a WPRE or HPRE.

In some embodiments, a lentiviral nucleic acid comprises one or more of, e.g., all of, e.g., from 5' to 3', a promoter (e.g., CMV), an R sequence (e.g., comprising TAR), a U5 sequence (e.g., for integration), a PBS sequence (e.g., for reverse transcription), a DIS sequence (e.g., for genome dimerization), a psi packaging signal, a partial gag sequence, an RRE sequence (e.g., for nuclear export), a cPPT sequence (e.g., for nuclear import), a promoter to drive expression of the exogenous agent, a gene encoding the exogenous agent, a WPRE sequence (e.g., for efficient transgene expression), a PPT sequence (e.g., for reverse transcription), an R sequence (e.g., for polyadenylation and termination), and a U5 signal (e.g., for integration).

ii) Vectors Engineered to Remove Splice Sites

Some lentiviral vectors integrate inside active genes and possess strong splicing and polyadenylation signals that could lead to the formation of aberrant and possibly truncated transcripts.

Mechanisms of proto-oncogene activation may involve the generation of chimeric transcripts originating from the interaction of promoter elements or splice sites contained in the genome of the insertional mutagen with the cellular transcriptional unit targeted by integration (Gabriel et al. 2009. Nat Med 15:1431-1436; Bokhoven, et al. J Virol 83:283-29). Chimeric fusion transcripts comprising vector sequences and cellular mRNAs can be generated either by read-through transcription starting from vector sequences and proceeding into the flanking cellular genes, or vice versa.

In some embodiments, a lentiviral nucleic acid described herein comprises a lentiviral backbone in which at least two of the splice sites have been eliminated, e.g., to improve the safety profile of the lentiviral vector. Species of such splice sites and methods of identification are described in WO2012156839A2, all of which is included by reference.

iii) Retroviral Production Methods

Large scale viral particle production is often useful to achieve a desired viral titer. Viral particles can be produced by transfecting a transfer vector into a packaging cell line that comprises viral structural and/or accessory genes, e.g., gag, pol, env, tat, rev, vif, vpr, vpu, vpx, or nef genes or other retroviral genes.

In embodiments, the packaging vector is an expression vector or viral vector that lacks a packaging signal and comprises a polynucleotide encoding one, two, three, four or more viral structural and/or accessory genes. Typically, the packaging vectors are included in a packaging cell, and are introduced into the cell via transfection, transduction or infection. A retroviral, e.g., lentiviral, transfer vector can be introduced into a packaging cell line, via transfection, transduction or infection, to generate a source cell or cell line. The packaging vectors can be introduced into human cells or cell lines by standard methods including, e.g., calcium phosphate transfection, lipofection or electroporation. In some embodiments, the packaging vectors are introduced into the cells together with a dominant selectable marker, such as neomycin, hygromycin, puromycin, blastocidin, zeocin, thymidine kinase, DHFR, Gln synthetase or ADA, followed by selection in the presence of the appropriate drug and isolation of clones. A selectable marker gene can be linked physically to genes encoding by the packaging vector, e.g., by IRES or self cleaving viral peptides.

Packaging cell lines include cell lines that do not contain a packaging signal, but do stably or transiently express viral structural proteins and replication enzymes (e.g., gag, pol and env) which can package viral particles. Any suitable cell line can be employed, e.g., mammalian cells, e.g., human cells. Suitable cell lines which can be used include, for example, CHO cells, BHK cells, MDCK cells, C3H 10T1/2 cells, FLY cells, Psi-2 cells, BOSC 23 cells, PA317 cells, WEHI cells, COS cells, BSC 1 cells, BSC 40 cells, BMT 10 cells, VERO cells, W138 cells, MRC5 cells, A549 cells, HT1080 cells, 293 cells, 293T cells, B-50 cells, 3T3 cells, NIH3T3 cells, HepG2 cells, Saos-2 cells, Huh7 cells, HeLa cells, W163 cells, 211 cells, and 211A cells. In embodiments, the packaging cells are 293 cells, 293T cells, or A549 cells.

A source cell line includes a cell line which is capable of producing recombinant retroviral particles, comprising a packaging cell line and a transfer vector construct comprising a packaging signal. Methods of preparing viral stock solutions are illustrated by, e.g., Y. Soneoka et al. (1995) *Nucl. Acids Res.* 23:628-633, and N. R. Landau et al. (1992) *J. Virol.* 66:5110-5113, which are incorporated herein by reference. Infectious virus particles may be collected from the packaging cells, e.g., by cell lysis, or collection of the supernatant of the cell culture. Optionally, the collected virus particles may be enriched or purified.

iv) Packaging Plasmids and Cell Lines

In some embodiments, the source cell comprises one or more plasmids coding for viral structural proteins and replication enzymes (e.g., gag, pol and env) which can package viral particles. In some embodiments, the sequences coding for at least two of the gag, pol, and env precursors are on the same plasmid. In some embodiments, the sequences coding for the gag, pol, and env precursors are on different plasmids. In some embodiments, the sequences coding for the gag, pol, and env precursors have the same expression signal, e.g., promoter. In some embodiments, the sequences coding for the gag, pol, and env precursors have a different expression signal, e.g., different promoters. In some embodiments, expression of the gag, pol, and env precursors is inducible. In some embodiments, the plasmids coding for viral structural proteins and replication enzymes are transfected at the same time or at different times. In some embodiments, the plasmids coding for viral structural proteins and replication enzymes are transfected at the same time or at a different time from the packaging vector.

In some embodiments, the source cell line comprises one or more stably integrated viral structural genes. In some embodiments expression of the stably integrated viral structural genes is inducible.

In some embodiments, expression of the viral structural genes is regulated at the transcriptional level. In some embodiments, expression of the viral structural genes is regulated at the translational level. In some embodiments, expression of the viral structural genes is regulated at the post-translational level.

In some embodiments, expression of the viral structural genes is regulated by a tetracycline (Tet)-dependent system, in which a Tet-regulated transcriptional repressor (Tet-R) binds to DNA sequences included in a promoter and represses transcription by steric hindrance (Yao et al, 1998; Jones et al, 2005). Upon addition of doxycycline (dox), Tet-R is released, allowing transcription. Multiple other suitable transcriptional regulatory promoters, transcription factors, and small molecule inducers are suitable to regulate transcription of viral structural genes.

In some embodiments, the third-generation lentivirus components, human immunodeficiency virus type 1 (HIV) Rev, Gag/Pol, and an envelope under the control of Tet-regulated promoters and coupled with antibiotic resistance cassettes are separately integrated into the source cell genome. In some embodiments the source cell only has one copy of each of Rev, Gag/Pol, and an envelope protein integrated into the genome.

In some embodiments a nucleic acid encoding the exogenous agent (e.g., a retroviral nucleic acid encoding the exogenous agent) is also integrated into the source cell genome. In some embodiments a nucleic acid encoding the exogenous agent is maintained episomally. In some embodiments a nucleic acid encoding the exogenous agent is transfected into the source cell that has stably integrated Rev, Gag/Pol, and an envelope protein in the genome. See, e.g., Milani et al. *EMBO Molecular Medicine,* 2017, which is herein incorporated by reference in its entirety.

In some embodiments, a retroviral nucleic acid described herein is unable to undergo reverse transcription. Such a nucleic acid, in embodiments, is able to transiently express an exogenous agent. The retrovirus or VLP, may comprise a disabled reverse transcriptase protein, or may not comprise a reverse transcriptase protein. In embodiments, the retroviral nucleic acid comprises a disabled primer binding site (PBS) and/or att site. In embodiments, one or more viral accessory genes, including rev, tat, vif, nef, vpr, vpu, vpx and S2 or functional equivalents thereof, are disabled or absent from the retroviral nucleic acid. In embodiments, one or more accessory genes selected from S2, rev and tat are disabled or absent from the retroviral nucleic acid.

v) Strategies for Packaging a Retroviral Nucleic Acid

Typically, modern retroviral vector systems consist of viral genomes bearing cis-acting vector sequences for transcription, reverse-transcription, integration, translation and packaging of viral RNA into the viral particles, and (2) producer cells lines which express the trans-acting retroviral gene sequences (e.g., gag, pol and env) needed for production of virus particles. By separating the cis- and trans-acting vector sequences completely, the virus is unable to maintain replication for more than one cycle of infection. Generation of live virus can be avoided by a number of strategies, e.g., by minimizing the overlap between the cis- and trans-acting sequences to avoid recombination.

A viral vector particle which comprises a sequence that is devoid of or lacking viral RNA may be the result of removing or eliminating the viral RNA from the sequence. In one embodiment this may be achieved by using an endogenous packaging signal binding site on gag. Alternatively, the endogenous packaging signal binding site is on pol. In this embodiment, the RNA which is to be delivered will contain a cognate packaging signal. In another embodiment, a heterologous binding domain (which is heterologous to gag) located on the RNA to be delivered, and a cognate binding site located on gag or pol, can be used to ensure packaging of the RNA to be delivered. The heterologous sequence could be non-viral or it could be viral, in which case it may be derived from a different virus. The vector particles could be used to deliver therapeutic RNA, in which case functional integrase and/or reverse transcriptase is not required. These vector particles could also be used to deliver a therapeutic gene of interest, in which case pol is typically included.

In an embodiment, gag-pol are altered, and the packaging signal is replaced with a corresponding packaging signal. In this embodiment, the particle can package the RNA with the new packaging signal. The advantage of this approach is that it is possible to package an RNA sequence which is devoid of viral sequence for example, RNAi.

An alternative approach is to rely on over-expression of the RNA to be packaged. In one embodiment the RNA to be packaged is over-expressed in the absence of any RNA containing a packaging signal. This may result in a significant level of therapeutic RNA being packaged, and that this amount is sufficient to transduce a cell and have a biological effect.

In some embodiments, a polynucleotide comprises a nucleotide sequence encoding a viral gag protein or retroviral gag and pol proteins, wherein the gag protein or pol protein comprises a heterologous RNA binding domain capable of recognising a corresponding sequence in an RNA sequence to facilitate packaging of the RNA sequence into a viral vector particle.

In some embodiments, the heterologous RNA binding domain comprises an RNA binding domain derived from a bacteriophage coat protein, a Rev protein, a protein of the U1 small nuclear ribonucleoprotein particle, a Nova protein, a TF111A protein, a TIS11 protein, a trp RNA-binding attenuation protein (TRAP) or a pseudouridine synthase.

In some embodiments, a method herein comprises detecting or confirming the absence of replication competent retrovirus. The methods may include assessing RNA levels of one or more target genes, such as viral genes, e.g. structural or packaging genes, from which gene products are expressed in certain cells infected with a replication-competent retrovirus, such as a gammaretrovirus or lentivirus, but not present in a viral vector used to transduce cells with a heterologous nucleic acid and not, or not expected to be, present and/or expressed in cells not containing replication-competent retrovirus. Replication competent retrovirus may be determined to be present if RNA levels of the one or more target genes is higher than a reference value, which can be measured directly or indirectly, e.g. from a positive control sample containing the target gene. For further disclosure, see WO2018023094A1.

vi) Repression of a Gene Encoding an Exogenous Agent in a Source Cell (Over-)expressed protein in the source cell may have an indirect or direct effect on vector virion assembly and/or infectivity. Incorporation of the exogenous agent into vector virions may also impact downstream processing of vector particles.

In some embodiments, a tissue-specific promoter is used to limit expression of the exogenous agent in source cells. In some embodiments, a heterologous translation control system is used in eukaryotic cell cultures to repress the translation of the exogenous agent in source cells. More specifically, the retroviral nucleic acid may comprise a binding site operably linked to the gene encoding the exogenous agent, wherein the binding site is capable of interacting with an RNA-binding protein such that translation of the exogenous agent is repressed or prevented in the source cell.

In some embodiments, the RNA-binding protein is tryptophan RNA-binding attenuation protein (TRAP), for example bacterial tryptophan RNA-binding attenuation protein. The use of an RNA-binding protein (e.g. the bacterial trp operon regulator protein, tryptophan RNA-binding attenuation protein, TRAP), and RNA targets to which it binds, will repress or prevent transgene translation within a source cell. This system is referred to as the Transgene Repression In vector Production cell system or TRIP system.

In embodiments, the placement of a binding site for an RNA binding protein (e.g., a TRAP-binding sequence, tbs) upstream of the NOI translation initiation codon allows specific repression of translation of mRNA derived from the internal expression cassette, while having no detrimental effect on production or stability of vector RNA. The number of nucleotides between the tbs and translation initiation codon of the gene encoding the exogenous agent may be varied from 0 to 12 nucleotides. The tbs may be placed downstream of an internal ribosome entry site (IRES) to repress translation of the gene encoding the exogenous agent in a multicistronic mRNA.

vii) Kill Switch Systems and Amplification

In some embodiments, a polynucleotide or cell harboring the gene encoding the exogenous agent utilizes a suicide gene, e.g., an inducible suicide gene, to reduce the risk of direct toxicity and/or uncontrolled proliferation. In specific aspects, the suicide gene is not immunogenic to the host cell harboring the exogenous agent. Examples of suicide genes include caspase-9, caspase-8, or cytosine deaminase. Caspase-9 can be activated using a specific chemical inducer of dimerization (CID).

In certain embodiments, vectors comprise gene segments that cause target cells, e.g., immune effector cells, e.g., T cells, to be susceptible to negative selection in vivo. For instance, the transduced cell can be eliminated as a result of a change in the in vivo condition of the individual. The negative selectable phenotype may result from the insertion of a gene that confers sensitivity to an administered agent, for example, a compound. Negative selectable genes are known in the art, and include, inter alia the following: the Herpes simplex virus type I thymidine kinase (HSV-I TK) gene (Wigler et al., Cell 11:223, 1977) which confers ganciclovir sensitivity; the cellular hypoxanthine phosphribosyltransferase (HPRT) gene, the cellular adenine phosphoribosyltransferase (APRT) gene, and bacterial cytosine deaminase, (Mullen et al., Proc. Natl. Acad. Sci. USA. 89:33 (1992)).

In some embodiments, transduced cells, e.g., immune effector cells, such as T cells, comprise a polynucleotide further comprising a positive marker that enables the selection of cells of the negative selectable phenotype in vitro. The positive selectable marker may be a gene which, upon being introduced into the target cell, expresses a dominant phenotype permitting positive selection of cells carrying the gene. Genes of this type include, inter alia, hygromycin-B phosphotransferase gene (hph) which confers resistance to hygromycin B, the amino glycoside phosphotransferase gene (neo or aph) from Tn5 which codes for resistance to the antibiotic G418, the dihydrofolate reductase (DHFR) gene, the adenosine deaminase gene (ADA), and the multi-drug resistance (MDR) gene.

In some embodiments, the positive selectable marker and the negative selectable element are linked such that loss of the negative selectable element necessarily also is accompanied by loss of the positive selectable marker. For instance, the positive and negative selectable markers can be fused so that loss of one obligatorily leads to loss of the other. An example of a fused polynucleotide that yields as an expression product a polypeptide that confers both the desired positive and negative selection features described above is a hygromycin phosphotransferase thymidine kinase fusion gene (HyTK). Expression of this gene yields a polypeptide that confers hygromycin B resistance for positive selection in vitro, and ganciclovir sensitivity for negative selection in vivo. See Lupton S. D., et al, Mol. and Cell. Biology 1 1:3374-3378, 1991. In addition, in embodiments, the polynucleotides encoding the chimeric receptors are in retroviral vectors containing the fused gene, particularly those that confer hygromycin B resistance for positive selection in vitro, and ganciclovir sensitivity for negative selection in vivo, for example the HyTK retroviral vector described in Lupton, S. D. et al. (1991), supra. See also the publications of PCT U591/08442 and PCT/US94/05601, describing the use of bifunctional selectable fusion genes derived from fusing dominant positive selectable markers with negative selectable markers.

Suitable positive selectable markers can be derived from genes selected from the group consisting of hph, nco, and gpt, and suitable negative selectable markers can be derived from genes selected from the group consisting of cytosine deaminase, HSV-I TK, VZV TK, HPRT, APRT and gpt. Other suitable markers are bifunctional selectable fusion genes wherein the positive selectable marker is derived from hph or neo, and the negative selectable marker is derived from cytosine deaminase or a TK gene or selectable marker.

viii) Strategies for Regulating Lentiviral Integration

Retroviral and lentiviral nucleic acids are disclosed which are lacking or disabled in key proteins/sequences so as to prevent integration of the retroviral or lentiviral genome into the target cell genome. For instance, viral nucleic acids lacking each of the amino acids making up the highly conserved DDE motif (Engelman and Craigie (1992) *J. Virol.* 66:6361-6369; Johnson et al. (1986) *Proc. Natl. Acad. Sci. USA* 83:7648-7652; Khan et al. (1991) *Nucleic Acids Res.* 19:851-860) of retroviral integrase enables the production of integration defective retroviral nucleic acids.

For instance, in some embodiments, a retroviral nucleic acid herein comprises a lentiviral integrase comprising a mutation that causes said integrase to be unable to catalyze the integration of the viral genome into a cell genome. In some embodiments, said mutations are type I mutations which affect directly the integration, or type II mutations which trigger pleiotropic defects affecting virion morphogenesis and/or reverse transcription. Illustrative non-limitative examples of type I mutations are those mutations affecting any of the three residues that participate in the catalytic core domain of the integrase: $DX_{39-58}DX_{35}E$ (D64, D116 and E152 residues of the integrase of the HIV-1). In a particular embodiment, the mutation that causes said integrase to be unable to catalyze the integration of the viral genome into a cell genome is the substitution of one or more amino acid residues of the DDE motif of the catalytic core domain of the integrase, preferably the substitution of the first aspartic residue of said DEE motif by an asparagine residue. In some embodiment the retroviral vector does not comprise an integrase protein.

In some embodiments the retrovirus integrates into active transcription units. In some embodiments the retrovirus does not integrate near transcriptional start sites, the 5' end of genes, or DNAse1 cleavage sites. In some embodiments the retrovirus integration does not active proto-oncogenes or inactive tumor suppressor genes. In some embodiments the retrovirus is not genotoxic. In some embodiments the lentivirus integrates into introns.

In some embodiments, the retroviral nucleic acid integrates into the genome of a target cell with a particular copy number. The average copy number may be determined from single cells, a population of cells, or individual cell colonies. Exemplary methods for determining copy number include polymerase chain reaction (PCR) and flow cytometry.

In some embodiments DNA encoding the exogenous agent is integrated into the genome. In some embodiments DNA encoding the exogenous agent is maintained episomally. In some embodiments the ratio of integrated to episomal DNA encoding the exogenous agent is at least 0.01, 0.1, 0.5, 1.0, 2, 5, 10, 100.

In some embodiments DNA encoding the exogenous agent is linear. In some embodiments DNA encoding the exogenous agent is circular. In some embodiments the ratio of linear to circular copies of DNA encoding the exogenous agent is at least 0.01, 0.1, 0.5, 1.0, 2, 5, 10, 100.

In embodiments the DNA encoding the exogenous agent is circular with 1 LTR. In some embodiments the DNA encoding the exogenous agent is circular with 2 LTRs. In some embodiments the ratio of circular, 1 LTR-comprising DNA encoding the exogenous agent to circular, 2 LTR-comprising DNA encoding the exogenous agent is at least 0.1, 0.5, 1.0, 2, 5, 10, 20, 50, 100.

ix) Maintenance of an Episomal Virus

In retroviruses deficient in integration, circular cDNA off-products of the retrotranscription (e.g., 1-LTR and 2-LTR) can accumulate in the cell nucleus without integrating into the host genome (see Yáñez-Muñoz R J et al., Nat. Med. 2006, 12:348-353). Like other exogenous DNA those intermediates can then integrate in the cellular DNA at equal frequencies (e.g., 103 to 105/cell).

In some embodiments, episomal retroviral nucleic acid does not replicate. Episomal virus DNA can be modified to be maintained in replicating cells through the inclusion of eukaryotic origin of replication and a scaffold/matrix attachment region (S/MAR) for association with the nuclear matrix.

Thus, in some embodiments, a retroviral nucleic acid described herein comprises a eukaryotic origin of replication or a variant thereof. Examples of eukaryotic origins of replication of interest are the origin of replication of the β-globin gene as have been described by Aladjem et al (Science, 1995, 270:815-819), a consensus sequence from autonomously replicating sequences associated with alpha-satellite sequences isolated previously from monkey CV-1 cells and human skin fibroblasts as has been described by Price et al Journal of Biological Chemistry, 2003, 278 (22): 19649-59, the origin of replication of the human c-myc promoter region has have been described by McWinney and Leffak (McWinney C. and Leffak M., Nucleic Acid Research 1990, 18 (5): 1233-42). In embodiments, the variant substantially maintains the ability to initiate the replication in eukaryotes. The ability of a particular sequence of initiating replication can be determined by any suitable method, for example, the autonomous replication assay based on bromodeoxyuridine incorporation and density shift (Araujo F. D. et al., supra; Frappier L. et al., supra).

In some embodiments, the retroviral nucleic acid comprises a scaffold/matrix attachment region (S/MAR) or variant thereof, e.g., a non-consensus-like AT-rich DNA element several hundred base pairs in length, which organizes the nuclear DNA of the eukaryotic genome into chromatin domains, by periodic attachment to the protein scaffold or matrix of the cell nucleus. They are typically found in non-coding regions such as flanking regions, chromatin border regions, and introns. Examples of S/MAR regions are 1.8 kbp S/MAR of the human IFN-γ gene (hIFN-$\gamma^{large}$) as described by Bode et al (Bode J. et al., Science, 1992, 255:195-7), the 0.7 Kbp minimal region of the S/MAR of the human IFN-γ gene (hIFN-$\gamma^{short}$) as has have been described by Ramezani (Ramezani A. et al., Blood 2003, 101:4717-24), the 0.2 Kbp minimal region of the S/MAR of the human dehydrofolate reductase gene (hDHFR) as has been described by Mesner L. D. et al., Proc Natl Acad Sci USA, 2003, 100:3281-86). In embodiments, the functionally equivalent variant of the S/MAR is a sequence selected based on the set six rules that together or alone have been suggested to contribute to S/MAR function (Kramer et al (1996) *Genomics* 33, 305; Singh et al (1997) *Nucl. Acids Res* 25, 1419). These rules have been merged into the MAR-Wiz computer program freely available at genomecluster.secs.oakland.edu/MAR-Wiz. In embodiments, the variant substantially maintains the same functions of the S/MAR from which it derives, in particular, the ability to specifically bind to the nuclear the matrix. The skilled person can determine if a particular variant is able to specifically bind to the nuclear matrix, for example by the in vitro or in vivo MAR assays described by Mesner et al. (Mesner L. D. et al, supra). In some embodiments, a specific sequence is a variant of a S/MAR if the particular variant shows propensity for DNA strand separation. This property can be determined using a specific program based on methods from equilibrium statistical mechanics. The stress-induced duplex destabilization (SIDD) analysis technique "[ . . . ] calculates the extent to which the imposed level of superhelical stress decreases the free energy needed to open the duplex at each position along a DNA sequence. The results are displayed as an SIDD profile, in which sites of strong destabilization appear as deep minima [ . . . ]" as defined in Bode et al (2005) *J. Mol. Biol.* 358,597. The SIDD algorithm and the mathematical basis (Bi and Benham (2004) Bioinformatics 20, 1477) and the analysis of the SIDD profile can be performed using the freely available internet resource at WebSIDD (genomecenter.ucdavis.edu/benham). Accordingly, in some embodiment, the polynucleotide is considered a variant of the S/MAR sequence if it shows a similar SIDD profile as the S/MAR.

B. Cell-Derived Fusosomes

Compositions of fusosomes may be generated from cells in culture, for example cultured mammalian cells, e.g., cultured human cells. The cells may be progenitor cells or non-progenitor (e.g., differentiated) cells. The cells may be primary cells or cell lines (e.g., a mammalian, e.g., human, cell line described herein). In embodiments, the cultured cells are progenitor cells, e.g., bone marrow stromal cells, marrow derived adult progenitor cells (MAPCs), endothelial progenitor cells (EPC), blast cells, intermediate progenitor cells formed in the subventricular zone, neural stem cells, muscle stem cells, satellite cells, liver stem cells, hematopoietic stem cells, bone marrow stromal cells, epidermal stem cells, embryonic stem cells, mesenchymal stem cells, umbilical cord stem cells, precursor cells, muscle precursor cells, myoblast, cardiomyoblast, neural precursor cells, glial precursor cells, neuronal precursor cells, hepatoblasts.

In some embodiments, the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial glial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell).

The cultured cells may be from epithelial, connective, muscular, or nervous tissue or cells, and combinations thereof. Fusosome can be generated from cultured cells from any eukaryotic (e.g., mammalian) organ system, for example, from the cardiovascular system (heart, vasculature); digestive system (esophagus, stomach, liver, gallbladder, pancreas, intestines, colon, rectum and anus); endocrine system (hypothalamus, pituitary gland, pineal body or pineal gland, thyroid, parathyroids, adrenal glands); excretory system (kidneys, ureters, bladder); lymphatic system (lymph, lymph nodes, lymph vessels, tonsils, adenoids, thymus, spleen); integumentary system (skin, hair, nails); muscular system (e.g., skeletal muscle); nervous system (brain, spinal cord, nerves); reproductive system (ovaries, uterus, mammary glands, testes, vas deferens, seminal vesicles, prostate); respiratory system (pharynx, larynx, trachea, bronchi, lungs, diaphragm); skeletal system (bone, cartilage), and combinations thereof. In embodiments, the cells are from a highly mitotic tissue (e.g., a highly mitotic healthy tissue, such as epithelium, embryonic tissue, bone marrow, intestinal crypts). In embodiments, the tissue sample is a highly metabolic tissue (e.g., skeletal tissue, neural tissue, cardiomyocytes).

In some embodiments, the cells are from a young donor, e.g., a donor 25 years, 20 years, 18 years, 16 years, 12 years, 10 years, 8 years of age, 5 years of age, 1 year of age, or less. In some embodiments, the cells are from fetal tissue.

In some embodiments, the cells are derived from a subject and administered to the same subject or a subject with a similar genetic signature (e.g., MHC-matched).

In certain embodiments, the cells have telomeres of average size greater than 3000, 4000, 5000, 6000, 7000, 8000, 9000, or 10000 nucleotides in length (e.g., between 4,000-10,000 nucleotides in length, between 6,000-10,000 nucleotides in length).

In some embodiments, fusosomes are generated from a cell clone identified, chosen, or selected based on a desirable phenotype or genotype for use as a source for fusosome composition described herein. For example, a cell clone is identified, chosen, or selected based on low mitochondrial mutation load, long telomere length, differentiation state, or a particular genetic signature (e.g., a genetic signature to match a recipient).

A fusosome composition described herein may be comprised of fusosomes from one cellular or tissue source, or from a combination of sources. For example, a fusosome composition may comprise fusosomes from xenogeneic sources (e.g., animals, tissue culture of the aforementioned species' cells), allogeneic, autologous, from specific tissues resulting in different protein concentrations and distributions (liver, skeletal, neural, adipose, etc.), from cells of different metabolic states (e.g., glycolytic, respiring). A composition may also comprise fusosomes in different metabolic states, e.g. coupled or uncoupled, as described elsewhere herein.

In some embodiments, fusosomes are generated from source cells expressing a fusogen, e.g., a fusogen described herein. In some embodiments, the fusogen is disposed in a membrane of the source cell, e.g., a lipid bilayer membrane, e.g., a cell surface membrane, or a subcellular membrane (e.g., lysosomal membrane). In some embodiments, fusosomes are generated from source cells with a fusogen disposed in a cell surface membrane.

In some embodiments, fusosomes are generated by inducing budding of an exosome, microvesicle, membrane vesicle, extracellular membrane vesicle, plasma membrane vesicle, giant plasma membrane vesicle, apoptotic body, mitoparticle, pyrenocyte, lysosome, or other membrane enclosed vesicle.

In some embodiments, fusosomes are generated by inducing cell enucleation. Enucleation may be performed using assays such as genetic, chemical (e.g., using Actinomycin D, see Bayona-Bafaluy et al., "A chemical enucleation method for the transfer of mitochondrial DNA to ρ° cells" Nucleic Acids Res. 2003 Aug. 15; 31 (16): e98), mechanical methods (e.g., squeezing or aspiration, see Lee et al., "A comparative study on the efficiency of two enucleation methods in pig somatic cell nuclear transfer: effects of the squeezing and the aspiration methods." Anim Biotechnol. 2008; 19 (2): 71-9), or combinations thereof. Enucleation refers not only to a complete removal of the nucleus but also the displacement of the nucleus from its typical location such that the cell contains the nucleus but it is non-functional.

In embodiments, making a fusosome comprises producing cell ghosts, giant plasma membrane vesicle, or apoptotic bodies. In embodiments, a fusosome composition comprises one or more of cell ghosts, giant plasma membrane vesicle, and apoptotic bodies.

In some embodiments, fusosomes are generated by inducing cell fragmentation. In some embodiments, cell fragmentation can be performed using the following methods, including, but not limited to: chemical methods, mechanical methods (e.g., centrifugation (e.g., ultracentrifugation, or density centrifugation), freeze-thaw, or sonication), or combinations thereof.

In some embodiments, a fusosome can be generated from a source cell expressing a fusogen, e.g., as described herein, by any one, all of, or a combination of the following methods:

- i) inducing budding of a mitoparticle, exosome, or other membrane enclosed vesicle;
- ii) inducing nuclear inactivation, e.g., enucleation, by any of the following methods or a combination thereof:
  - a) a genetic method;
  - b) a chemical method, e.g., using Actinomycin D; or
  - c) a mechanical method, e.g., squeezing or aspiration; or
- iii) inducing cell fragmentation, e.g., by any of the following methods or a combination thereof:
  - a) a chemical method;
  - b) a mechanical method, e.g., centrifugation (e.g., ultracentrifugation or density centrifugation); freeze thaw; or sonication.

i) Modifications to Cells Prior to Fusosome Generation

In some aspects, a modification is made to a cell, such as modification of a subject, tissue or cell, prior to fusosome generation. Such modifications can be effective to, e.g., improve fusion, fusogen expression or activity, structure or function of the cargo, or structure or function of the target cell.

a) Physical Modifications

In some embodiments, a cell is physically modified prior to generating the fusosome. For example, as described elsewhere herein, a fusogen may be linked to the surface of the cell.

In some embodiments, a cell is treated with a chemical agent prior to generating the fusosome. For example, the cell may be treated with a chemical or lipid fusogen, such that the chemical or lipid fusogen non-covalently or covalently interacts with the surface of the cell or embeds within the surface of the cell. In some embodiments, the cell is treated with an agent to enhance fusogenic properties of the lipids in the cell membrane.

In some embodiments, the cell is physically modified prior to generating the fusosome with one or more covalent or non-covalent attachment sites for synthetic or endogenous small molecules or lipids on the cell surface that enhance targeting of the fusosome to an organ, tissues, or cell-type.

In embodiments, a fusosome comprises increased or decreased levels of an endogenous molecule. For instance, the fusosome may comprise an endogenous molecule that also naturally occurs in the naturally occurring source cell but at a higher or lower level than in the fusosome. In some embodiments, the polypeptide is expressed from an exogenous nucleic acid in the source cell or fusosome. In some embodiments, the polypeptide is isolated from a source and loaded into or conjugated to a source cell or fusosome.

In some embodiments, a cell is treated with a chemical agent, e.g., small molecule, prior to generating the fusosome to increase the expression or activity of an endogenous fusogen in the cell (e.g., in some embodiments, endogenous relative to the source cell, and in some embodiments, endogenous relative to the target cell). In some embodiments, a small molecule may increase expression or activity of a transcriptional activator of the endogenous fusogen. In some embodiments, a small molecule may decrease expression or activity of a transcriptional repressor of the endogenous fusogen. In some embodiments, a small molecule is an epigenetic modifier that increases expression of the endogenous fusogen.

In some embodiments, fusosomes are generated from cells treated with fusion arresting compounds, e.g., lysophosphatidylcholine. In some embodiments, fusosomes are generated from cells treated with dissociation reagents that do not cleave fusogens, e.g., Accutase.

In some embodiments, a source cell is physically modified with, e.g., CRISPR activators, prior to generating a fusosome to add or increase the concentration of fusogens.

In some embodiments, the cell is physically modified to increase or decrease the quantity, or enhance the structure or function of organelles, e.g., mitochondria, Golgi apparatus, endoplasmic reticulum, intracellular vesicles (such as lysosomes, autophagosomes).

b) Genetic Modifications

In some embodiments, a cell is genetically modified prior to generating the fusosome to increase the expression of an endogenous fusogen in the cell (e.g., in some embodiments, endogenous relative to the source cell, and in some embodiments, endogenous relative to the target cell. In some embodiments, a genetic modification may increase expression or activity of a transcriptional activator of the endogenous fusogen. In some embodiments, a genetic modification may decrease expression or activity of a transcriptional repressor of the endogenous fusogen. In some embodiments the activator or repressor is a nuclease-inactive cas9 (dCas9) linked to a transcriptional activator or repressor that is targeted to the endogenous fusogen by a guide RNA. In some embodiments, a genetic modification epigenetically modifies an endogenous fusogen gene to increase its expression. In some embodiments the epigenetic activator a nuclease-inactive cas9 (dCas9) linked to an epigenetic modifier that is targeted to the endogenous fusogen by a guide RNA.

In some embodiments, a cell is genetically modified prior to generating the fusosome to increase the expression of an exogenous fusogen in the cell, e.g., delivery of a transgene.

In some embodiments, a nucleic acid, e.g., DNA, mRNA or siRNA, is transferred to the cell prior to generating the fusosome, e.g., to increase or decrease the expression of a cell surface molecule (protein, glycan, lipid or low molecular weight molecule) used for organ, tissue, or cell targeting. In some embodiments, the nucleic acid targets a repressor of a fusogen, e.g., an shRNA, siRNA construct. In some embodiments, the nucleic acid encodes an inhibitor of a fusogen repressor.

In some embodiments, the method comprises introducing a nucleic acid, that is exogenous relative to the source cell encoding a fusogen into a source cell. The exogenous nucleic acid may be, e.g., DNA or RNA. In some embodiments the exogenous nucleic acid may be e.g., a DNA, a gDNA, a cDNA, an RNA, a pre-mRNA, an mRNA, an miRNA, an siRNA, etc. In some embodiments, the exogenous DNA may be linear DNA, circular DNA, or an artificial chromosome. In some embodiments the DNA is maintained episomally. In some embodiments the DNA is integrated into the genome. The exogenous RNA may be chemically modified RNA, e.g., may comprise one or more backbone modification, sugar modifications, noncanonical bases, or caps. Backbone modifications include, e.g., phosphorothioate, N3' phosphoramidite, boranophosphate, phosphonoacetate, thio-PACE, morpholino phosphoramidites, or PNA. Sugar modifications include, e.g., 2'-O-Me, 2'F, 2'F-ANA, LNA, UNA, and 2'-O-MOE. Noncanonical bases include, e.g., 5-bromo-U, and 5-iodo-U, 2,6-diaminopurine, C-5 propynyl pyrimidine, difluorotoluene, difluorobenzene, dichlorobenzene, 2-thiouridine, pseudouridine, and dihydrouridine. Caps include, e.g., ARCA. Additional modifications are discussed, e.g., in Deleavey et al., "Designing Chemically Modified Oligonucleotides for Targeted Gene Silencing" Chemistry & Biology Volume 19, Issue 8, 24 Aug. 2012, Pages 937-954, which is herein incorporated by reference in its entirety.

In some embodiments, a cell is treated with a chemical agent, e.g. a small molecule, prior to generating the fusosome to increase the expression or activity of a fusogen that is exogenous relative to the source cell in the cell. In some embodiments, a small molecule may increase expression or activity of a transcriptional activator of the exogenous fusogen. In some embodiments, a small molecule may decrease expression or activity of a transcriptional repressor of the exogenous fusogen. In some embodiments, a small molecule is an epigenetic modifier that increases expression of the exogenous fusogen.

In some embodiments, the nucleic acid encodes a modified fusogen. For example, a fusogen that has regulatable fusogenic activity, e.g., specific cell-type, tissue-type or local microenvironment activity. Such regulatable fusogenic activity may include, activation and/or initiation of fusogenic activity by low pH, high pH, heat, infrared light, extracellular enzyme activity (eukaryotic or prokaryotic), or exposure of a small molecule, a protein, or a lipid. In some embodiments, the small molecule, protein, or lipid is displayed on a target cell.

In some embodiments, a cell is genetically modified prior to generating the fusosome to alter (i.e., upregulate or downregulate) the expression of signaling pathways (e.g., the Wnt/Beta-catenin pathway). In some embodiments, a cell is genetically modified prior to generating the fusosome to alter (e.g., upregulate or downregulate) the expression of a gene or genes of interest. In some embodiments, a cell is genetically modified prior to generating the fusosome to alter (e.g., upregulate or downregulate) the expression of a nucleic acid (e.g. a miRNA or mRNA) or nucleic acids of interest. In some embodiments, nucleic acids, e.g., DNA, mRNA or siRNA, are transferred to the cell prior to generating the fusosome, e.g., to increase or decrease the expression of signaling pathways, genes, or nucleic acids. In some embodiments, the nucleic acid targets a repressor of a signaling pathway, gene, or nucleic acid, or represses a signaling pathway, gene, or nucleic acid. In some embodiments, the nucleic acid encodes a transcription factor that upregulates or downregulates a signaling pathway, gene, or nucleic acid. In some embodiments the activator or repressor is a nuclease-inactive cas9 (dCas9) linked to a transcriptional activator or repressor that is targeted to the signaling pathway, gene, or nucleic acid by a guide RNA. In some embodiments, a genetic modification epigenetically modifies an endogenous signaling pathway, gene, or nucleic acid to its expression. In some embodiments the epigenetic activator a nuclease-inactive cas9 (dCas9) linked to a epigenetic modifier that is targeted to the signaling pathway, gene, or nucleic acid by a guide RNA. In some embodiments, a cell's DNA is edited prior to generating the fusosome to alter (e.g., upregulate or downregulate) the expression of signaling pathways (e.g. the Wnt/Beta-catenin pathway), gene, or nucleic acid. In some embodiments, the DNA is edited using a guide RNA and CRISPR-Cas9/Cpf1 or other gene editing technology.

A cell may be genetically modified using recombinant methods. A nucleic acid sequence coding for a desired gene can be obtained using recombinant methods, such as, for example by screening libraries from cells expressing the gene, by deriving the gene from a vector known to include the same, or by isolating directly from cells and tissues containing the same, using standard techniques. Alternatively, a gene of interest can be produced synthetically, rather than cloned.

Expression of natural or synthetic nucleic acids is typically achieved by operably linking a nucleic acid encoding the gene of interest to a promoter, and incorporating the construct into an expression vector. The vectors can be suitable for replication and integration in eukaryotes. Typical cloning vectors contain transcription and translation terminators, initiation sequences, and promoters useful for expression of the desired nucleic acid sequence.

In some embodiments, a cell may be genetically modified with one or more expression regions, e.g., a gene. In some embodiments, the cell may be genetically modified with an exogenous gene (e.g., capable of expressing an exogenous gene product such as an RNA or a polypeptide product) and/or an exogenous regulatory nucleic acid. In some embodiments, the cell may be genetically modified with an exogenous sequence encoding a gene product that is endogenous to a target cell and/or an exogenous regulatory nucleic acid capable of modulating expression of an endogenous gene. In some embodiments, the cell may be genetically modified with an exogenous gene and/or a regulatory nucleic acid that modulates expression of an exogenous gene. In some embodiments, the cell may be genetically modified with an exogenous gene and/or a regulatory nucleic acid that modulates expression of an endogenous gene. It will be understood by one of skill in the art that the cell described herein may be genetically modified to express a variety of exogenous genes that encode proteins or regulatory molecules, which may, e.g., act on a gene product of the endogenous or exogenous genome of a target cell. In some embodiments, such genes confer characteristics to the fusosome, e.g., modulate fusion with a target cell. In some embodiments, the cell may be genetically modified to express an endogenous gene and/or regulatory nucleic acid.

In some embodiments, the endogenous gene or regulatory nucleic acid modulates the expression of other endogenous genes. In some embodiments, the cell may be genetically modified to express an endogenous gene and/or regulatory nucleic acid which is expressed differently (e.g., inducibly, tissue-specifically, constitutively, or at a higher or lower level) than a version of the endogenous gene and/or regulatory nucleic acid on other chromosomes.

The promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor −1a (EF-1a). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter.

Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a tissue-specific promoter, metallothionine promoter, a glucocorticoid promoter, a progesterone promoter, and a tetracycline promoter. In some embodiments, expression of a fusogen is upregulated before fusosomes are generated, e.g., 3, 6, 9, 12, 24, 26, 48, 60, or 72 hours before fusosomes are generated.

The expression vector to be introduced into the source can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes may be used for identifying potentially transfected cells and for evaluating the functionality of regulatory sequences. In general, a reporter gene is a gene that is not present in or expressed by the recipient source and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479:79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In some embodiments, a cell may be genetically modified to alter expression of one or more proteins. Expression of the one or more proteins may be modified for a specific time, e.g., development or differentiation state of the source. In some embodiments, fusosomes are generated from a source of cells genetically modified to alter expression of one or more proteins, e.g., fusogen proteins or non-fusogen proteins that affect fusion activity, structure or function. Expression of the one or more proteins may be restricted to a specific location(s) or widespread throughout the source.

In some embodiments, the expression of a fusogen protein is modified. In some embodiments, fusosomes are generated from cells with modified expression of a fusogen protein, e.g., an increase or a decrease in expression of a fusogen by at least 10%, 15%, 20%, 30%, 40%, 50%, 60%, 75%, 80%, 90% or more.

In some embodiments, cells may be engineered to express a cytosolic enzyme (e.g., proteases, phosphatases, kinases, demethylases, methyltransferases, acetylases) that targets a fusogen protein. In some embodiments, the cytosolic enzyme affects one or more fusogens by altering post-translational modifications. Post-translational protein modifications of proteins may affect responsiveness to nutrient availability and redox conditions, and protein-protein interactions. In some embodiments, a fusosome comprises fusogens with altered post-translational modifications, e.g., an increase or a decrease in post-translational modifications by at least 10%, 15%, 20%, 30%, 40%, 50%, 60%, 75%, 80%, 90% or more.

Methods of introducing a modification into a cell include physical, biological and chemical methods. See, for example, Geng. & Lu, Microfluidic electroporation for cellular analysis and delivery. Lab on a Chip. 13 (19): 3803-21. 2013; Sharei, A. et al. A vector-free microfluidic platform for intracellular delivery. PNAS vol. 110 no. 6. 2013; Yin, H. et al., Non-viral vectors for gene-based therapy. Nature Reviews Genetics. 15:541-555. 2014. Suitable methods for modifying a cell for use in generating the fusosomes described herein include, for example, diffusion, osmosis, osmotic pulsing, osmotic shock, hypotonic lysis, hypotonic dialysis, ionophoresis, electroporation, sonication, microinjection, calcium precipitation, membrane intercalation, lipid mediated transfection, detergent treatment, viral infection, receptor mediated endocytosis, use of protein transduction domains, particle firing, membrane fusion, freeze-thawing, mechanical disruption, and filtration.

Confirming the presence of a genetic modification includes a variety of assays. Such assays include, for example, molecular biological assays, such as Southern and Northern blotting, RT-PCR and PCR; biochemical assays, such as detecting the presence or absence of a particular peptide, e.g., by immunological means (ELISAs and Western blots) or by assays described herein.

The present disclosure provides, in some aspects, a fusosome comprising: (a) a lipid bilayer, (b) a lumen (e.g., comprising cytosol) surrounded by the lipid bilayer; (c) an exogenous or overexpressed fusogen, e.g., wherein the fusogen is disposed in the lipid bilayer, wherein the fusosome is derived from a source cell; and wherein the fusosome has partial or complete nuclear inactivation (e.g., nuclear removal).

The present disclosure provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a nucleic acid, e.g., a nucleic acid comprising a payload gene; and wherein the fusosome does not comprise a nucleus; wherein the amount of viral capsid protein in the fusosome composition is less than 1% of total protein; wherein: (i) when the plurality of fusosomes are contacted with a cell population comprising target cells and non-target cells, the cargo is present in at least 10-fold more target cells than non-target cells or reference cells, or (ii) the fusosomes of the plurality fuse at a higher rate with a target cell than with a non-target cell or reference cell by at least at least 50%; wherein the target cell is chosen from an alpha beta T cell, an effector T cell, a CD8+ cytotoxic T cell, a thymus-derived regulatory T cell, a peripherally derived regulatory T cell, a CD4+Foxp3+ regulatory T cell, or a CD4+FoxP3-type 1 regulatory T (Tr1) cell, a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell.

The present disclosure provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a nucleic acid comprising a payload gene encoding an exogenous agent of Table 5, wherein the fusosome does not comprise a nucleus; and wherein the amount of viral capsid protein in the fusosome composition is less than 1% of total protein.

The present disclosure provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a nucleic acid comprising a payload gene, wherein the nucleic acid comprises a NTCSRE operably linked to the payload gene, wherein the NTCSRE comprises a non-target cell-specific miRNA recognition sequence, e.g., a non-target cell-specific miRNA recognition sequence bound by a miRNA present in a non-target cell at a higher level than in a target cell, e.g., a non-target cell-specific miRNA recognition sequence bound by a miRNA of Table 4, wherein the target cell is a first type of T cell, optionally wherein the non-target cell is a second, different type of T cell or a non-T cell; and wherein the fusosome does not comprise a nucleus; and wherein the amount of viral capsid protein in the fusosome composition is less than 1% of total protein.

In some embodiments, the miRNA is present in a non-target cell (e.g., a non-target cell described herein) at a level at least 10, 100, 1,000, or 10,000 times higher than the level of the miRNA present in the target cell (e.g., a T cell). In some embodiments, the miRNA is not detectably present in a target cell (e.g., a T cell, e.g., a T cell described herein). In some embodiments, the miRNA is not present in the target cell (e.g., a T cell, e.g., a T cell described herein).

The present disclosure provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a nucleic acid comprising a payload gene, wherein the nucleic acid comprises a promoter operably linked to the payload gene, wherein the promoter is a T cell-specific promoter, e.g., is a promoter specific for a T cell, a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell; wherein the fusosome does not comprise a nucleus; and wherein the amount of viral capsid protein in the fusosome composition is less than 1% of total protein.

The present disclosure provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a nucleic acid comprising a payload gene, wherein the nucleic acid comprises a promoter having sequence of a promoter in Table 3, or a sequence having at least 70%, 75%, 80%, 85%, 90%, 95%, 96%, 97%, 98%, or 99% identity thereto; wherein the fusosome does not comprise a nucleus; and wherein the amount of viral capsid protein in the fusosome composition is less than 1% of total protein.

The present disclosure provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a nucleic acid comprising: (i) a payload gene; (ii) a NTCSRE operably linked to the payload gene, e.g., wherein the NTCSRE comprises a non-target cell-specific miRNA recognition sequence, e.g., a non-target cell-specific miRNA recognition sequence bound by a miRNA of Table 4, and (iii) optionally, a positive target cell-specific regulatory element, e.g., a positive target cell-specific regulatory element (e.g., a target cell-specific promoter) operatively linked to the payload gene, wherein the positive target cell-specific regulatory element increases expression of the payload gene in a target cell relative to an otherwise similar fusosome lacking the positive target cell-specific regulatory element, wherein the target cell is a first type of T cell; optionally wherein the non-target cell is a second, different type of T cell or a non-T cell, optionally wherein the target cell is a Treg cell and the non-target cell is a conventional CD4+ T cell; wherein the fusosome does not comprise a nucleus; and wherein the amount of viral capsid protein in the fusosome composition is less than 1% of total protein.

In some embodiments, one or more of the following is present: i) the fusosome comprises or is comprised by a cytobiologic; ii) the fusosome comprises an enucleated cell; iii) the fusosome comprises an inactivated nucleus; iv) the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, 2-fold, 3-fold, 4-fold, 5-fold, 10-fold, 20-fold, 50-fold, or 100-fold, e.g., in an assay of Example 42; v) the fusosome fuses at a higher rate with a target cell than with other fusosomes, e.g., by at least 10%, 20%, 30%, 40%, 50%, 60%, 70%, 80%, or 90%, 2-fold, 3-fold, 4-fold, 5-fold, 10-fold, 20-fold, 50-fold, or 100-fold, e.g., in an assay of Example 42; vi) the fusosome fuses with target cells at a rate such that an agent in the fusosome is delivered to at least 10%, 20%, 30%, 40%, 50%, 60%, 70%, 80%, or 90%, of target cells after 24, 48, or 72 hours, e.g., in an assay of Example 42; vii) the fusogen is present at a copy number of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000, 000, 500,000,000, or 1,000,000,000 copies, e.g., as measured by an assay of Example 26; viii) the fusosome comprises a therapeutic agent at a copy number of at least, or no more than, 10, 50, 100, 500, 1,000, 2,000, 5,000, 10,000, 20,000, 50,000, 100,000, 200,000, 500,000, 1,000, 000, 5,000,000, 10,000,000, 50,000,000, 100,000,000, 500, 000,000, or 1,000,000,000 copies, e.g., as measured by an assay of Example 88; ix) the ratio of the copy number of the fusogen to the copy number of the therapeutic agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000; x) the fusosome comprises a lipid composition substantially similar to that of the source cell or wherein one or more of CL, Cer, DAG, HexCer, LPA, LPC, LPE, LPG, LPI, LPS, PA, PC, PE, PG, PI, PS, CE, SM and TAG is within 10%, 15%, 20%, 25%, 30%, 35%, 40%, 45%, 50%, 55%, 60%, 65%, 70%, or 75% of the corresponding lipid level in the source cell; xi) the fusosome comprises a proteomic composition similar to that of the source cell, e.g., using an assay of Example 87; xii) the fusosome comprises a ratio of lipids to proteins that is within 10%, 20%, 30%, 40%, or 50% of the corresponding ratio in the source cell, e.g., as measured using an assay of Example 40; xiii) the fusosome comprises a ratio of proteins to nucleic acids (e.g., DNA) that is within 10%, 20%, 30%, 40%, or 50% of the corresponding ratio in the source cell, e.g., as measured using an assay of Example 41; xiv) the fusosome comprises a ratio of lipids to nucleic acids (e.g., DNA) that is within 10%, 20%, 30%, 40%, or 50% of the corresponding ratio in the source cell, e.g., as measured using an assay of Example 91; xv) the fusosome has a half-life in a subject, e.g., in a mouse, that is within 1%, 2%, 3%, 4%, 5%, 10%, 20%, 30%, 40%, 50%, 60%, 70%, 80%, 90%, 100% of the half life of a reference cell, e.g., the source cell, e.g., by an assay of Example 60;

xvi) the fusosome transports glucose (e.g., labeled glucose, e.g., 2-NBDG) across a membrane, e.g., by at least 1%, 2%, 3%, 4%, 5%, 10%, 20%, 30%, 40%, 50%, 60%, 70%, 80%, 90%, 100% more (e.g., about 11.6% more) than a negative control, e.g., an otherwise similar fusosome in the absence of glucose, e.g., as measured using an assay of Example 50; xvii) the fusosome comprises esterase activity in the lumen that is within 1%, 2%, 3%, 4%, 5%, 10%, 20%, 30%, 40%, 50%, 60%, 70%, 80%, 90%, or 100% of that of the esterase activity in a reference cell, e.g., the source cell or a mouse embryonic fibroblast, e.g., using an assay of Example 51;

xviii) the fusosome comprises a metabolic activity level that is within 1%, 2%, 3%, 4%, 5%, 10%, 20%, 30%, 40%, 50%, 60%, 70%, 80%, 90%, or 100% of the citrate synthase activity in a reference cell, e.g., the source cell, e.g., as described in Example 53; xiv) the fusosome comprises a respiration level (e.g., oxygen consumption rate) that is within 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 54; xx) the fusosome comprises an Annexin-V staining level of at most 18,000, 17,000, 16,000, 15,000, 14,000, 13,000, 12,000, 11,000, or 10,000 MFI, e.g., using an assay of Example 55, or wherein the fusosome comprises an Annexin-V staining level at least 5%, 10%, 20%, 30%, 40%, or 50% lower than the Annexin-V staining level of an otherwise similar fusosome treated with menadione in the assay of Example 55, or wherein the fusosome comprises an Annexin-V staining level at least 5%, 10%, 20%, 30%, 40%, or 50% lower than the Annexin-V staining level of a macrophage treated with menadione in the assay of Example 55, xxi) the fusosome has a miRNA content level of at least at least 1%, 2%, 3%, 4%, 5%, 10%, 20%, 30%, 40%, 50%, 60%, 70%, 80%, 90%, or greater than that of the source cell, e.g., by an assay of Example 33; xxii) the fusosome has a soluble: non-soluble protein ratio is within 1%, 2%, 3%, 4%, 5%, 10%, 20%, 30%, 40%, 50%, 60%, 70%, 80%, 90%, or greater than that of the source cell, e.g., within 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of that of the source cell, e.g., by an assay of Example 38; xxiii) the fusosome has an LPS level less than 5%, 1%, 0.5%, 0.01%, 0.005%, 0.0001%, 0.00001% or less of the LPS content of the source cell, e.g., as measured by mass spectrometry, e.g., in an assay of Example 39; xxiv) the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of insulin, e.g., using an assay of Example 49; xxv) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, 0.5%, 1%, 1.5%, 2%, 2.5%, 3%, 4%, 5%, 10%, 20%, 30%, 40%, 50%, 60%, 70%, 80%, or 90% of the fusosomes in a population of administered fusosomes are present in the target tissue after 24, 48, or 72 hours, e.g., by an assay of Example 64; xxvi) the fusosome has juxtacrine-signaling level of at least 1%, 2%, 3%, 4%, 5%, 10%, 20%, 30%, 40%, 50%, 60%, 70%, 80%, 90%, or 100% greater than the level of juxtacrine signaling induced by a reference cell, e.g., the source cell or a bone marrow stromal cell (BMSC), e.g., by an assay of Example 56; xxvii) the fusosome has paracrine-signaling level of at least 1%, 2%, 3%, 4%, 5%, 10%, 20%, 30%, 40%, 50%, 60%, 70%, 80%, 90%, 100% greater than the level of paracrine signaling induced by a reference cell, e.g., the source cell or a macrophage, e.g., by an assay of Example 57; xxviii) the fusosome polymerizes actin at a level within 1%, 2%, 3%, 4%, 5%, 10%, 20%, 30%, 40%, 50%, 60%, 70%, 80%, 90%, or 100% compared to the level of polymerized actin in a reference cell, e.g., the source cell or a C2C12 cell, e.g., by the assay of Example 58; xxix) the fusosome has a membrane potential within about 1%, 2%, 3%, 4%, 5%, 10%, 20%, 30%, 40%, 50%, 60%, 70%, 80%, 90%, 100% of the membrane potential of a reference cell, e.g., the source cell or a C2C12 cell, e.g., by an assay of Example 59, or wherein the fusosome has a membrane potential of about −20 to −150 mV, −20 to −50 mV, −50 to −100 mV, or −100 to −150 mV; xxx) the fusosome is capable of extravasation from blood vessels, e.g., at a rate at least 1%, 2%, 5%, 10%, 20%, 30%, 40%, 50%, 60%, 70%, 80%, or 90% the rate of extravasation of the source cell or of a cell of the same type as the source cell, e.g., using an assay of Example 44, e.g., wherein the source cell is a neutrophil, lymphocyte, B cell, macrophage, or NK cell; xxxi) the fusosome is capable of crossing a cell membrane, e.g., an endothelial cell membrane or the blood brain barrier; xxxii) the fusosome is capable of secreting a protein, e.g., at a rate at least 1%, 2%, 3%, 4%, 5%, 10%, 20%, 30%, 40%, 50%, 60%, 70%, 80%, 90%, or 100% greater than a reference cell, e.g., a mouse embryonic fibroblast, e.g., using an assay of Example 48; xxxiii) the fusosome meets a pharmaceutical or good manufacturing practices (GMP) standard; xxxiv) the fusosome was made according to good manufacturing practices (GMP); xxxv) the fusosome has a pathogen level below a predetermined reference value, e.g., is substantially free of pathogens; xxxvi) the fusosome has a contaminant level below a predetermined reference value, e.g., is substantially free of contaminants; xxxvii) the fusosome has low immunogenicity, e.g., as described herein; xxxviii) the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell; or xxxix) the source cell is other than a 293 cell, HEK cell, human endothelial cell, or a human epithelial cell, monocyte, macrophage, dendritic cell, or stem cell.

The present disclosure also provides, in some aspects, a fusosome comprising: a) a lipid bilayer and a lumen that is miscible with an aqueous solution, e.g., water, wherein the fusosome is derived from a source cell, b) an exogenous or overexpressed fusogen disposed in the lipid bilayer, and c) an organelle, e.g., a therapeutically effective number of organelles, disposed in the lumen.

In some embodiments, one or more of the following is present: i) the source cell is selected from an endothelial cell, a macrophage, a neutrophil, a granulocyte, a leukocyte, a stem cell (e.g., a mesenchymal stem cell, a bone marrow stem cell, an induced pluripotent stem cell, an embryonic stem cell), a myeloblast, a myoblast, a hepatocyte, or a neuron e.g., retinal neuronal cell; ii) the organelle is selected from a Golgi apparatus, lysosome, endoplasmic reticulum, mitochondria, vacuole, endosome, acrosome, autophagosome, centriole, glycosome, glyoxysome, hydrogenosome, melanosome, mitosome, cnidocyst, peroxisome, proteasome, vesicle, and stress granule; iii) the fusosome has a size of greater than 5 μm, 10 μm, 20 μm, 50 um, or 100 μm; iv) the fusosome, or a composition or preparation comprising a plurality of the fusosomes, has a density of other than between 1.08 g/ml and 1.12 g/ml, e.g., the fusosome has a density of 1.25 g/ml+/−0.05, e.g., as measured by an assay of Example 30; v) the fusosome is not captured by the scavenger system in circulation or by Kupffer cells in the sinus of the liver; vi) the source cell is other than a 293 cell; vii) the source cell is not transformed or immortalized; viii) the source cell is transformed, or immortalized using a method other than adenovirus-mediated immortalization, e.g., immortalized by spontaneous mutation, or telomerase expression; ix) the fusogen is other than VSVG, a SNARE protein, or a secretory granule protein; x) the fusosome does not comprise Cre or GFP, e.g., EGFP; xi) the fusosome further comprises an exogenous protein other than Cre or GFP, e.g., EGFP xii) the fusosome further comprises an exogenous nucleic acid (e.g., RNA, e.g., mRNA, miRNA, or siRNA) or an exogenous protein (e.g., an antibody, e.g., an antibody), e.g., in the lumen; or xiii) the fusosome does not comprise mitochondria.

The present disclosure also provides, in some aspects, a fusosome comprising: (a) a lipid bilayer, (b) a lumen (e.g., comprising cytosol) surrounded by the lipid bilayer, (c) an exogenous or overexpressed fusogen, e.g., wherein the fusogen is disposed in the lipid bilayer, and (d) a functional nucleus, wherein the fusosome is derived from a source cell.

In some embodiments, one or more of the following is present: i) the source cell is other than a dendritic cell or tumor cell, e.g., the source cell is selected from an endothelial cell, a macrophage, a neutrophil, a granulocyte, a leukocyte, a stem cell (e.g., a mesenchymal stem cell, a bone marrow stem cell, an induced pluripotent stem cell, an embryonic stem cell), a myeloblast, a myoblast, a hepatocyte, or a neuron e.g., retinal neuronal cell; ii) the fusogen is other than a fusogenic glycoprotein; iii) the fusogen is a mammalian protein other than fertilin-beta, iv) the fusosome has low immunogenicity, e.g., as described herein; v) the fusosome meets a pharmaceutical or good manufacturing practices (GMP) standard; vi) the fusosome was made according to good manufacturing practices (GMP); vii) the fusosome has a pathogen level below a predetermined reference value, e.g., is substantially free of pathogens; or viii) the fusosome has a contaminant level below a predetermined reference value, e.g., is substantially free of contaminants.

The present disclosure also provides, in some aspects, a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a cargo; and wherein the fusosome does not comprise a nucleus; wherein the amount of viral capsid protein in the fusosome composition is less than 1% of total protein; wherein the plurality of fusosomes, when contacted with a target cell population in the presence of an inhibitor of endocytosis, and when contacted with a reference target cell population not treated with the inhibitor of endocytosis, delivers the cargo to at least 30% of the number of cells in the target cell population compared to the reference target cell population.

The present disclosure also provides, in some aspects, a fusosome composition comprising a plurality of fusosomes derived from a source cell, and wherein the fusosomes of the plurality comprise: (a) a lipid bilayer, (b) a lumen comprising cytosol, wherein the lumen is surrounded by the lipid bilayer; (c) an exogenous or overexpressed re-targeted fusogen disposed in the lipid bilayer; (d) a cargo; and wherein the fusosome does not comprise a nucleus; wherein the amount of viral capsid protein in the fusosome composition is less than 1% of total protein; wherein: (i) when the plurality of fusosomes are contacted with a cell population comprising target cells and non-target cells, the cargo is present in at least 2-fold, 5-fold, 10-fold, 20-fold, 50-fold, or 100-fold more target cells than non-target cells, or (ii) the fusosomes of the plurality fuse at a higher rate with a target cell than with a non-target cell by at least at least 50%.

The present disclosure also provides, in some aspects, a fusosome composition comprising a plurality of fusosomes derived from a source cell, and wherein the fusosomes of the plurality comprise: (a) a lipid bilayer, (b) a lumen surrounded by the lipid bilayer; (c) an exogenous or overexpressed fusogen, wherein the fusogen is disposed in the lipid bilayer; and (d) a cargo; wherein the fusosome does not comprise a nucleus; and wherein one or more of (e.g., at least 2, 3, 4, or 5 of): i) the fusogen is present at a copy number of at least 1,000 copies; ii) the fusosome comprises a therapeutic agent at a copy number of at least 1,000 copies; iii) the fusosome comprises a lipid wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell; iv) the fusosome comprises a proteomic composition similar to that of the source cell; v) the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin; vi) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, or 10%, of the fusosomes in a population of administered fusosomes are present in the target tissue after 24 hours; or the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell.

In embodiments, one or more of: i) the source cell is other than a 293 cell; ii) the source cell is not transformed or immortalized; iii) the source cell is transformed or immortalized using a method other than adenovirus-mediated immortalization, e.g., immortalized by spontaneous mutation or telomerase expression; iv) the fusogen is other than VSVG, a SNARE protein, or a secretory granule protein; v) the therapeutic agent is other than Cre or EGFP; vi) the therapeutic agent is a nucleic acid (e.g., RNA, e.g., mRNA, miRNA, or siRNA) or an exogenous protein (e.g., an antibody, e.g., an antibody), e.g., in the lumen; or vii) the fusosome does not comprise mitochondria.

In embodiments, one or more of: i) the source cell is other than a 293 or HEK cell; ii) the source cell is not transformed or immortalized; iii) the source cell is transformed or immortalized using a method other than adenovirus-mediated immortalization, e.g., immortalized by spontaneous mutation or telomerase expression; iv) the fusogen is not a viral fusogen; or v) the fusosome has a size of other than between 40 and 150 nm, e.g., greater than 150 nm, 200 nm, 300 nm, 400 nm, or 500 nm.

In embodiments, one or more of: i) the therapeutic agent is a soluble protein expressed by the source cell; ii) the fusogen is other than TAT, TAT-HA2, HA-2, gp41, Alzheimer's beta-amyloid peptide, a Sendai virus protein, or amphipathic net-negative peptide (WAE 11); iii) the fusogen is a mammalian fusogen; iv) the fusosome comprises in its lumen a polypeptide selected from an enzyme, antibody, or anti-viral polypeptide; v) the fusosome does not comprise an exogenous therapeutic transmembrane protein; or vi) the fusosome does not comprise CD63 or GLUT4, or the fusosome comprises less than or equal to 0.05%, 0.1%, 0.5%, 1%, 2%, 3%, 4%, 5%, or 10% CD63 (e.g., about 0.048% or less), e.g., as determined according to the method described in Example 89.

In embodiments, the fusosome: i) does not comprise a virus, is not infectious, or does not propagate in a host cell; ii) is not a viral vector, iii) is not a VLP (virus like particle); iv) does not comprise a viral structural protein, e.g., a protein derived from gag, e.g. a viral capsid protein, e.g. a viral capsule protein, e.g., a viral nucleocapsid protein, or wherein the amount of viral capsid protein is less than 10%, 5%, 4%, 3%, 2%, 1%, 0.5%, 0.2%, or 0.1% of total protein, e.g., by mass spectrometry, e.g. using an assay of Example 93; v) does not comprise a viral matrix protein; vi) does not comprise a viral non-structural protein; e.g. pol or a fragment or variant thereof, a viral reverse transcriptase protein, a viral integrase protein, or a viral protease protein. vii) does not comprise viral nucleic acid; e.g. viral RNA or viral DNA; viii) comprises less than 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies per vesicle of a viral structural protein; or ix) the fusosome is not a virosome.

In some embodiments, the fusosome comprises (or is identified as comprising) less than about 0.01%, 0.05%, 0.1%, 0.5%, 1%, 5%, 10%, 15%, 20%, 25%, 30%, 35%, 40%, 45%, 50%, 60%, 70%, 80%, 90%, 95%, 96%, 97%, 98%, or 99% viral capsid protein (e.g., about 0.05% viral capsid protein). In embodiments, the viral capsid protein is Complex of Rabbit Endogenous Lentivirus (RELIK) Capsid with Cyclophilin A. In embodiments, the viral capsid protein: total protein ratio is (or is identified as being) about 0.01, 0.02, 0.03, 0.04, 0.05, 0.06, 0.07, 0.08, 0.09, or 0.1.

In some embodiments, the fusosome does not comprise (or is identified as not comprising) a gag protein or a fragment or variant thereof, or the amount of gag protein or fragment or variant thereof is less than 10%, 5%, 4%, 3%, 2%, 1%, 0.5%, 0.2%, or 0.1% of total protein, e.g., by an assay of Example 93.

In embodiments, the ratio of the copy number of the fusogen to the copy number of viral structural protein on the fusosome is at least 1,000,000:1, 100,000:1, 10,000:1, 1,000:1, 100:1, 50:1, 20:1, 10:1, 5:1, or 1:1; or is between 100:1 and 50:1, 50:1 and 20:1, 20:1 and 10:1, 10:1 and 5:1 or 1:1. In embodiments, the ratio of the copy number of the fusogen to the copy number of viral matrix protein on the fusosome is at least 1,000,000:1, 100.000:1, 10,000:1, 1,000:1, 100:1, 50:1, 20:1, 10:1, 5:1, or 1:1.

In embodiments, one or more of: i) the fusosome does not comprise a water-immiscible droplet; ii) the fusosome comprises an aqueous lumen and a hydrophilic exterior; iii) the fusogen is a protein fusogen; or iv) the organelle is selected from a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule.

In embodiments, one or more of: i) the fusogen is a mammalian fusogen or a viral fusogen; ii) the fusosome was not made by loading the fusosome with a therapeutic or diagnostic substance; iii) the source cell was not loaded with a therapeutic or diagnostic substance; iv) the fusosome does not comprise doxorubicin, dexamethasone, cyclodextrin; polyethylene glycol, a micro RNA e.g., miR125, VEGF receptor, ICAM-1, E-selectin, iron oxide, a fluorescent protein e.g., GFP or RFP, a nanoparticle, or an RNase, or does not comprise an exogenous form of any of the foregoing; or v) the fusosome further comprises an exogenous therapeutic agent having one or more post-translational modifications, e.g., glycosylation.

In embodiments, the fusosome is unilamellar or multilamellar.

In embodiments, one or more of: i) the fusosome is not an exosome; ii) the fusosome is a microvesicle; iii) the fusosome comprises a non-mammalian fusogen; iv) the fusosome has been engineered to incorporate a fusogen; v) the fusosome comprises an exogenous fusogen; vi) the fusosome has a size of at least 80 nm, 100 nm, 200 nm, 500 nm, 1000 nm, 1200 nm, 1400 nm, or 1500 nm, or a population of fusosomes has an average size of at least 80 nm, 100 nm, 200 nm, 500 nm, 1000 nm, 1200 nm, 1400 nm, or 1500 nm; vii) the fusosome comprises one or more organelles, e.g., a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule; viii) the fusosome comprises a cytoskeleton or a component thereof, e.g., actin, Arp2/3, formin, coronin, dystrophin, keratin, myosin, or tubulin; ix) the fusosome, or a composition or preparation comprising a plurality of the fusosomes, does not have a flotation density of 1.08-1.22 g/ml, or has a density of at least 1.18-1.25 g/ml, or 1.05-1.12 g/ml, e.g., in a sucrose gradient centrifugation assay, e.g., as described in Théry et al., "Isolation and characterization of exosomes from cell culture supernatants and biological fluids." Curr Protoc Cell Biol. 2006 April; Chapter 3: Unit 3.22; x) the lipid bilayer is enriched for ceramides or sphingomyelins or a combination thereof compared to the source cell, or the lipid bilayer is not enriched (e.g., is depleted) for glycolipids, free fatty acids, or phosphatidylserine, or a combination thereof, compared to the source cell; xi) the fusosome comprises Phosphatidyl serine (PS) or CD40 ligand or both of PS and CD40 ligand, e.g., when measured in an assay of Example 92; xii) the fusosome is enriched for PS compared to the source cell, e.g., in a population of fusosomes at least 5%, 10%, 20%, 30%, 40%, 50%, 60%, 70%, 80%, or 90% are positive for PS, e.g., by an assay of Kanada M, et al. (2015) Differential fates of biomolecules delivered to target cells via extracellular vesicles. Proc Natl Acad Sci USA 112: E1433-E1442; xiii) the fusosome is substantially free of acetylcholinesterase (AChE), or contains less than 0.001, 0.002, 0.005, 0.01, 0.02, 0.05, 0.1, 0.2, 0.5, 1, 2, 5, 10, 20, 50, 100, 200, 500, or 1000 AChE activity units/ug of protein, e.g., by an assay of Example 52; xiv) the fusosome is substantially free of a Tetraspanin family protein (e.g., CD63, CD9, or CD81), an ESCRT-related protein (e.g., TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72), or any combination thereof, or contains less than 0.05%, 0.1%, 0.5%, 1%, 2%, 3%, 4%, 5%, 5%, or 10% of any individual exosomal marker protein and/or less than 0.05%, 0.1%, 0.5%, 1%, 2%, 3%, 4%, 5%, 10%, 15%, 20%, or 25% of total exosomal marker proteins of any of said proteins, or is de-enriched for any one or more of these proteins compared to the source cell, or is not enriched for any one or more of these proteins, e.g., by an assay of Example 89; xv) the fusosome comprises a level of Glyceraldehyde 3-phosphate dehydrogenase (GAPDH) that is below 500, 250, 100, 50, 20, 10, 5, or 1 ng GAPDH/ug total protein or below the level of GAPDH in the source cell, e.g., less than 1%, 2.5%, 5%, 10%, 15%, 20%, 30%, 40%, 50%, 60%, 70%, 80%, or 90%, less than the level of GAPDH per total protein in ng/ug in the source cell, e.g., using an assay of Example 36; xvi) the fusosome is enriched for one or more endoplasmic reticulum proteins (e.g., calnexin), one or more proteasome proteins, or one or more mitochondrial proteins, or any combination thereof, e.g., wherein the amount of calnexin is less than 500, 250, 100, 50, 20, 10, 5, or 1 ng Calnexin/ug total protein, or wherein the fusosome comprises less Calnexin per total protein in ng/ug compared to the source cell by 1%, 2.5%, 5%, 10%, 15%, 20%, 30%, 40%, 50%, 60%, 70%, 80%, or 90%, e.g., using an assay of Example 37 or 90, or wherein the average fractional content of Calnexin in the fusosome is less than about $1\times10^{-4}$, $1.5\times10^{-4}$, $2\times10^{-4}$, $2.1\times10^{-4}$, $2.2\times10^{4}$, $2.3\times10^{-4}$, $2.4\times10^{4}$, $2.43\times10^{-4}$, $2.5\times10^{-4}$, $2.6\times10^{4}$, $2.7\times10^{-4}$, $2.8\times10^{-4}$, $2.9\times10^{4}$, $3\times10^{4}$, $3.5\times10^{4}$, or $4\times10^{4}$, or wherein the fusosome comprises an amount of Calnexin per total protein that is lower than that of the parental cell by about 70%, 75%, 80%, 85%, 88%, 90%, 95%, 99%, or more; xvii) the fusosome comprises an exogenous agent (e.g., an exogenous protein, mRNA, or siRNA) e.g., as measured using an assay of Example 34; or xviii) the fusosome can be immobilized on a mica surface by atomic force microscopy for at least 30 min, e.g., by an assay of Kanada M, et al. (2015) Differential fates of biomolecules delivered to target cells via extracellular vesicles. Proc Natl Acad Sci USA 112: E1433-E1442.

In embodiments, one or more of: i) the fusosome is an exosome; ii) the fusosome is not a microvesicle; iii) the fusosome has a size of less than 80 nm, 100 nm, 200 nm, 500 nm, 1000 nm, 1200 nm, 1400 nm, or 1500 nm, or a population of fusosomes has an average size of less than 80 nm, 100 nm, 200 nm, 500 nm, 1000 nm, 1200 nm, 1400 nm, or 1500 nm; iv) the fusosome does not comprise an organelle; v) the fusosome does not comprise a cytoskeleton or a component thereof, e.g., actin, Arp2/3, formin, coronin, dystrophin, keratin, myosin, or tubulin; vi) the fusosome, or a composition or preparation comprising a plurality of the fusosomes, has flotation density of 1.08-1.22 g/ml, e.g., in a sucrose gradient centrifugation assay, e.g., as described in Théry et al., "Isolation and characterization of exosomes from cell culture supernatants and biological fluids." Curr Protoc Cell Biol. 2006 April; Chapter 3: Unit 3.22; vii) the lipid bilayer is not enriched (e.g., is depleted) for ceramides or sphingomyelins or a combination thereof compared to the source cell, or the lipid bilayer is enriched for glycolipids, free fatty acids, or phosphatidylserine, or a combination thereof, compared to the source cell; viii) the fusosome does not comprise, or is depleted for relative to the source cell, Phosphatidyl serine (PS) or CD40 ligand or both of PS and CD40 ligand, e.g., when measured in an assay of Example 92; ix) the fusosome is not enriched (e.g., is depleted) for PS compared to the source cell, e.g., in a population of fusosomes less than 20%, 30%, 40%, 50%, 60%, 70%, 80%, or 90% are positive for PS, e.g., by an assay of Kanada M, et al. (2015) Differential fates of biomolecules delivered to target cells via extracellular vesicles. Proc Natl Acad Sci USA 112: E1433-E1442; x) the fusosome comprises acetylcholinesterase (AChE), e.g. at least 0.001, 0.002, 0.005, 0.01, 0.02, 0.05, 0.1, 0.2, 0.5, 1, 2, 5, 10, 20, 50, 100, 200, 500, or 1000 AChE activity units/ug of protein, e.g., by an assay of Example 52; xi) the fusosome comprises a Tetraspanin family protein (e.g., CD63, CD9, or CD81), an ESCRT-related protein (e.g., TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72), or any combination thereof, e.g., contains more than 0.05%, 0.1%, 0.5%, 1%, 2%, 3%, 4%, 5%, 5%, or 10% of any individual exosomal marker protein and/or less than 0.05%, 0.1%, 0.5%, 1%, 2%, 3%, 4%, 5%, 10%, 15%, 20%, or 25% of total exosomal marker proteins of any of said proteins, or is enriched for any one or more of these proteins compared to the source cell, e.g., by an assay of Example 89; xii) the fusosome comprises a level of Glyceraldehyde 3-phosphate dehydrogenase (GAPDH) that is above 500, 250, 100, 50, 20, 10, 5, or 1 ng GAPDH/ug total protein or below the level of GAPDH in the source cell, e.g., at least 1%, 2.5%, 5%, 10%, 15%, 20%, 30%, 40%, 50%, 60%, 70%, 80%, or 90%, greater than the level of GAPDH per total protein in ng/ug in the source cell, e.g., using an assay of Example 36; xiii) the fusosome is not enriched for (e.g., is depleted for) one or more endoplasmic reticulum proteins (e.g., calnexin), one or more proteasome proteins, or one or more mitochondrial proteins, or any combination thereof, e.g., wherein the amount of calnexin is less than 500, 250, 100, 50, 20, 10, 5, or 1 ng Calnexin/ug total protein, or wherein the fusosome comprises less Calnexin per total protein in ng/ug compared to the source cell by 1%, 2.5%, 5%, 10%, 15%, 20%, 30%, 40%, 50%, 60%, 70%, 80%, or 90%, e.g., using an assay of Example 90, or wherein the average fractional content of Calnexin in the fusosome is less than about $1\times10^{4}$, $1.5\times10^{-4}$, $2\times10^{4}$, $2.1\times10^{4}$, $2.2\times10^{-4}$, $2.3\times10^{-4}$, $2.4\times10^{-4}$, $2.43\times10^{-4}$, $2.5\times10^{-4}$, $2.6\times10^{4}$, $2.7\times10^{4}$, $2.8\times10^{-4}$, $2.9\times10^{-4}$, $3\times10^{4}$, $3.5\times10^{4}$, or $4\times10^{-4}$, or wherein the fusosome comprises an amount of Calnexin per total protein that is lower than that of the parental cell by about 70%, 75%, 80%, 85%, 88%, 90%, 95%, 99%, or more; or xiv) the fusosome can not be immobilized on a mica surface by atomic force microscopy for at least 30 min, e.g., by an assay of Kanada M, et al. (2015) Differential fates of biomolecules delivered to target cells via extracellular vesicles. Proc Natl Acad Sci USA 112: E1433-E1442.

In embodiments, one or more of: i) the fusosome does not comprise a VLP; ii) the fusosome does not comprise a virus; iii) the fusosome does not comprise a replication-competent virus; iv) the fusosome does not comprise a viral protein, e.g., a viral structural protein, e.g., a capsid protein or a viral matrix protein; v) the fusosome does not comprise a capsid protein from an enveloped virus; vi) the fusosome does not comprise a nucleocapsid protein; or vii) the fusogen is not a viral fusogen.

In embodiments, the fusosome comprises cytosol.

In embodiments, one or more of: i) the fusosome or the source cell does not form a teratoma when implanted into subject, e.g., by an assay of Example 65; ii) the fusosome is capable of chemotaxis, e.g., of within 1%, 2%, 3%, 4%, 5%, 10%, 20%, 30%, 40%, 50%, 60%, 70%, 80%, 90%, 100% or greater than a reference cell, e.g., a macrophage, e.g., using an assay of Example 45; iii) the fusosome is capable of homing, e.g., at the site of an injury, wherein the fusosome or cytobiologic is from a human cell, e.g., using an assay of Example 46, e.g., wherein the source cell is a neutrophil; or iv) the fusosome is capable of phagocytosis, e.g., wherein phagocytosis by the fusosome is detectable within 0.5, 1, 2, 3, 4, 5, or 6 hours in using an assay of Example 47, e.g., wherein the source cell is a macrophage.

In embodiments, the fusosome or fusosome composition retains one, two, three, four, five, six or more of any of the characteristics for 5 days or less, e.g., 4 days or less, 3 days or less, 2 days or less, 1 day or less, e.g., about 12-72 hours, after administration into a subject, e.g., a human subject.

In embodiments, the fusosome has one or more of the following characteristics: a) comprises one or more endogenous proteins from a source cell, e.g., membrane proteins or cytosolic proteins; b) comprises at least 10, 20, 50, 100, 200, 500, 1000, 2000, or 5000 different proteins; c) comprises at least 1, 2, 5, 10, 20, 50, or 100 different glycoproteins; d) at least 10%, 20%, 30%, 40%, 50%, 60%, 70%, 80%, or 90% by mass of the proteins in the fusosome are naturally-occurring proteins; e) comprises at least 10, 20, 50, 100, 200, 500, 1000, 2000, or 5000 different RNAs; or f) comprises at least 2, 3, 4, 5, 10, or 20 different lipids, e.g., selected from CL, Cer, DAG, HexCer, LPA, LPC, LPE, LPG, LPI, LPS, PA, PC, PE, PG, PI, PS, CE, SM and TAG.

In embodiments, the fusosome has been manipulated to have, or the fusosome is not a naturally occurring cell and has, or wherein the nucleus does not naturally have one, two, three, four, five or more of the following properties: a) the partial nuclear inactivation results in a reduction of at least 50%, 60%, 70%, 80%, 90% or more in nuclear function, e.g., a reduction in transcription or DNA replication, or both, e.g., wherein transcription is measured by an assay of Example 24 and DNA replication is measured by an assay of Example 25; b) the fusosome is not capable of transcription or has transcriptional activity of less than 1%, 2.5% 5%, 10%, 20%, 30%, 40%, 50%, 60%, 70%, 80%, or 90% of that of the transcriptional activity of a reference cell, e.g., the source cell, e.g., using an assay of Example 24; c) the fusosome is not capable of nuclear DNA replication or has nuclear DNA replication of less than 1%, 2.5% 5%, 10%, 20%, 30%, 40%, 50%, 60%, 70%, 80%, or 90% of the nuclear DNA replication of a reference cell, e.g., the source cell, e.g., using an assay of Example 25; d) the fusosome lacks chromatin or has a chromatin content of less than 1%, 2.5% 5%, 10%, 20%, 30%, 40%, 50%, 60%, 70%, 80%, or 90% of the of the chromatin content of a reference cell, e.g., the source cell, e.g., using an assay of Example 32; e) the fusosome lacks a nuclear membrane or has less than 50%, 40%, 30%, 20%, 10%, 5%, 4%, 3%, 2%, or 1% the amount of nuclear membrane of a reference cell, e.g., the source cell or a Jurkat cell, e.g., by an assay of Example 31; f) the fusosome lacks functional nuclear pore complexes or has reduced nuclear import or export activity, e.g., by at least 50%, 40%, 30%, 20%, 10%, 5%, 4%, 3%, 2%, or 1% by an assay of Example 31, or the fusosome lacks on or more of a nuclear pore protein, e.g., NUP98 or Importin 7; g) the fusosome does not comprise histones or has histone levels less than 1%, 2%, 3%, 4%, 5%, 10%, 20%, 30%, 40%, 50%, 60%, 70%, 80%, or 90% of the histone level of the source cell (e.g., of H1, H2a, H2b, H3, or H4), e.g., by an assay of Example 32; h) the fusosome comprises less than 20, 10, 5, 4, 3, 2, or 1 chromosome; i) nuclear function is eliminated;

j) the fusosome is an enucleated mammalian cell; k) the nucleus is removed or inactivated, e.g., extruded by mechanical force, by radiation or by chemical ablation; or 1) the fusosome is from a mammalian cell having DNA that is completely or partially removed, e.g., during interphase or mitosis.

In embodiments, the fusosome comprises mtDNA or vector DNA. In embodiments, the fusosome does not comprise DNA.

In embodiments, the source cell is a primary cell, immortalized cell or a cell line (e.g., myelobast cell line, e.g., C2C12). In embodiments, the fusosome is from a source cell having a modified genome, e.g., having reduced immunogenicity (e.g., by genome editing, e.g., to remove an MHC protein or MHC complexes). In embodiments, the source cell is from a cell culture treated with an anti-inflammatory signal. In embodiments, the source cell is from a cell culture treated with an immunosuppressive agent. In embodiments, the source cell is substantially non-immunogenic, e.g., using an assay described herein. In embodiments, the source cell comprises an exogenous agent, e.g., a therapeutic agent. In embodiments, the source cell is a recombinant cell.

In embodiments, the fusosome further comprises an exogenous agent, e.g., a therapeutic agent, e.g., a protein or a nucleic acid (e.g., a DNA, a chromosome (e.g. a human artificial chromosome), an RNA, e.g., an mRNA or miRNA). In embodiments, the exogenous agent is present at at least, or no more than, 10, 20, 50, 100, 200, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., comprised by the fusosome, or is present at an average level of at least, or no more than, 10, 20, 50, 100, 200, 500, 1,000, 2,000, 5,000, 10,000, 20,000, 50,000, 100,000, 200,000, 500,000 or 1,000,000 copies per fusosome. In embodiments, the fusosome has an altered, e.g., increased or decreased level of one or more endogenous molecules, e.g., protein or nucleic acid, e.g., due to treatment of the mammalian cell with a siRNA or gene editing enzyme. In embodiments, the endogenous molecule is present at, e.g. an average level, of at least, or no more than, 10, 20, 50, 100, 200, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies (e.g., copies comprised by the fusosome), or is present at an average level of at least, or no more than, 10, 20, 50, 100, 200, 500, 1,000, 2,000, 5,000, 10,000, 20,000, 50,000, 100,000, 200,000, 500,000 or 1,000,000 copies per fusosome. In embodiments, the endogenous molecule (e.g., an RNA or protein) is present at a concentration of at least 1, 2, 3, 4, 5, 10, 20, 50, 100, 500, 103, $5.0\times10^3$, $10^4$, $5.0\times10^4$, $10^5$, $5.0\times10^5$, $10^6$, $5.0\times10^6$, $1.0\times10^7$, $5.0\times10^7$, or $1.0\times10^8$, greater than its concentration in the source cell.

In embodiments, the active agent is selected from a protein, protein complex (e.g., comprising at least 2, 3, 4, 5, 10, 20, or 50 proteins, e.g., at least at least 2, 3, 4, 5, 10, 20, or 50 different proteins) polypeptide, nucleic acid (e.g., DNA, chromosome, or RNA, e.g., mRNA, siRNA, or miRNA) or small molecule. In embodiments, the exogenous agent comprises a site-specific nuclease, e.g., Cas9 molecule, TALEN, or ZFN.

In embodiments, the fusogen is a viral fusogen, e.g., HA, HIV-1 ENV, HHV-4, gp120, or VSV-G. In embodiments, the fusogen is a mammalian fusogen, e.g., a SNARE, a Syncytin, myomaker, myomixer, myomerger, or FGFRL1. In embodiments, the fusogen is active at a pH of 4-5, 5-6, 6-7, 7-8, 8-9, or 9-10. In embodiments, the fusogen is not active at a pH of 4-5, 5-6, 6-7, 7-8, 8-9, or 9-10. In embodiments, the fusosome fuses to a target cell at the surface of the target cell. In embodiments, the fusogen promotes fusion in a lysosome-independent manner. In embodiments, the fusogen is a protein fusogen. In embodiments, the fusogen is a lipid fusogen, e.g., oleic acid, glycerol mono-oleate, a glyceride, diacylglycerol, or a modified unsaturated fatty acid. In embodiments, the fusogen is a chemical fusogen, e.g., PEG. In embodiments, the fusogen is a small molecule fusogen, e.g., halothane, an NSAID such as meloxicam, piroxicam, tenoxicam, and chlorpromazine. In embodiments, the fusogen is recombinant. In embodiments, the fusogen is biochemically incorporated, e.g., the fusogen is provided as a purified protein and contacted with a lipid bilayer under conditions that allow for associate of the fusogen with the lipid bilayer. In embodiments, the fusogen is biosynthetically incorporated, e.g. expressed in a source cell under conditions that allow the fusogen to associate with the lipid bilayer.

In embodiments, the fusosome binds a target cell. In embodiments, the target cell is other than a HeLa cell, or the target cell is not transformed or immortalized.

In some embodiments involving fusosome compositions, the plurality of fusosomes are the same. In some embodiments, the plurality of fusosomes are different. In some embodiments the plurality of fusosomes are from one or more source cells. In some embodiments at least 50%, 60%, 70%, 80%, 90%, 95%, or 99% of fusosomes in the plurality have a diameter within 10%, 20%, 30%, 40%, or 50% of the mean diameter of the fusosomes in the fusosome composition. In some embodiments at least 50%, 60%, 70%, 80%, 90%, 95%, or 99% of fusosomes in the plurality have a volume within 10%, 20%, 30%, 40%, or 50% of the mean volume of the fusosomes in the fusosome composition. In some embodiments, the fusosome composition has less than about 90%, 80%, 70%, 60%, 50%, 40%, 30%, 20%, 10%, 5%, variability in size distribution within 10%, 50%, or 90% of the source cell population variability in size distribution, e.g., based on Example 28. In some embodiments, at least 50%, 60%, 70%, 80%, 90%, 95%, or 99% of fusosomes in the plurality have a copy number of the fusogen within 10%, 20%, 30%, 40%, 50%, 60%, 70%, 80%, or 90% of the mean fusogen copy number in the fusosomes in the fusosome composition. In some embodiments, at least 50%, 60%, 70%, 80%, 90%, 95%, or 99% of fusosomes in the plurality have a copy number of the therapeutic agent within 10%, 20%, 30%, 40%, 50%, 60%, 70%, 80%, or 90% of the mean therapeutic agent copy number in the fusosomes in the fusosome composition. In some embodiments, the fusosome composition comprises at least $10^5$, $10^6$, $10^7$, $10^8$, $10^9$, $10^{10}$, $10^{11}$, $10^{12}$, $10^{13}$, $10^{14}$, or $10^{15}$ or more fusosomes. In some embodiments, the fusosome composition is in a volume of at least 1 ul, 2 ul, 5 ul, 10 ul, 20 ul, 50 ul, 100 ul, 200 ul, 500 ul, 1 ml, 2 ml, 5 ml, or 10 ml.

In some embodiments, the fusosome composition delivers the cargo to at least 40%, 45%, 50%, 55%, 60%, 65%, 70%, 75%, 80%, 85%, 90%, 95%, 96%, 97%, 98%, or 99% of the number of cells in the target cell population compared to the reference target cell population.

In some embodiments, the fusosome composition delivers at least 40%, 45%, 50%, 55%, 60%, 65%, 70%, 75%, 80%, 85%, 90%, 95%, 96%, 97%, 98%, or 99% of the cargo to the target cell population compared to the reference target cell population or to a non-target cell population. In some embodiments, the fusosome composition delivers at least 40%, 45%, 50%, 55%, 60%, 65%, 70%, 75%, 80%, 85%, 90%, 95%, 96%, 97%, 98%, or 99% more of the cargo to the target cell population compared to the reference target cell population or to a non-target cell population.

In some embodiments, less than 10% of cargo enters the cell by endocytosis.

In some embodiments, the inhibitor of endocytosis is an inhibitor of lysosomal acidification, e.g., bafilomycin A1. In some embodiments, the inhibitor of endocytosis is a dynamin inhibitor, e.g., Dynasore.

In some embodiments, the target cell population is at a physiological pH (e.g., between 7.3-7.5, e.g., between 7.38-7.42).

In some embodiments, the cargo delivered is determined using an endocytosis inhibition assay, e.g., an assay of Example 80.

In some embodiments, cargo enters the cell through a dynamin-independent pathway or a lysosomal acidification-independent pathway, a macropinocytosis-independent pathway (e.g., wherein the inhibitor of endocytosis is an inhibitor of macropinocytosis, e.g., 5-(N-ethyl-N-isopropyl) amiloride (EIPA), e.g., at a concentration of 25 μM), or an actin-independent pathway (e.g., wherein the inhibitor of endocytosis is an inhibitor of actin polymerization is, e.g., Latrunculin B, e.g., at a concentration of 6 μM).

In some embodiments, the fusosomes of the plurality further comprise a targeting moiety. In embodiments, the targeting moiety is comprised by the fusogen or is comprised by a separate molecule.

In some embodiments, when the plurality of fusosomes are contacted with a cell population comprising target cells and non-target cells, the cargo is present in at least 10-fold more target cells than non-target cells.

In some embodiments, when the plurality of fusosomes are contacted with a cell population comprising target cells and non-target cells, the cargo is present at least 2-fold, 5-fold, 10-fold, 20-fold, or 50-fold higher in target cells than non-target cells and/or the cargo is present at least 2-fold, 5-fold, 10-fold, 20-fold, or 50-fold higher in target cells than reference cells.

In some embodiments, the fusosomes of the plurality fuse at a higher rate with a target cell than with a non-target cell by at least 50%.

In some embodiments, the fusosome, when contacted with a target cell population, delivers cargo to a target cell location other than an endosome or lysosome, e.g., to the cytosol. In embodiments, less 50%, 40%, 30%, 20%, or 10% of the cargo is delivered to an endosome or lysosome.

In some embodiments, the fusosomes of the plurality comprise exosomes, microvesicles, or a combination thereof.

In some embodiments, the plurality of fusosomes has an average size of at least 50 nm, 100 nm, 200 nm, 500 nm, 1000 nm, 1200 nm, 1400 nm, or 1500 nm. In other embodiments, the plurality of fusosomes has an average size of less than 100 nm, 80 nm, 60 nm, 40 nm, or 30 nm.

In some embodiments, the fusogen (e.g., re-targeted fusogen) comprises a mammalian fusogen. In some embodiments, the fusogen (e.g., re-targeted fusogen) comprises a viral fusogen. In some embodiments, the fusogen (e.g., re-targeted fusogen) is a protein fusogen. In some embodiments, the fusogen (e.g., re-targeted fusogen) comprises a sequence chosen from a Nipah virus protein F, a measles virus F protein, a tupaia paramyxovirus F protein, a paramyxovirus F protein, a Hendra virus F protein, a Henipavirus F protein, a Morbilivirus F protein, a respirovirus F protein, a Sendai virus F protein, a rubulavirus F protein, or an avulavirus F protein, or a derivative thereof.

In some embodiments, the fusogen (e.g., re-targeted fusogen) is active at a pH of 4-5, 5-6, 6-7, 7-8, 8-9, or 9-10. In some embodiments, the fusogen (e.g., re-targeted fusogen) is not active at a pH of 4-5, 5-6, 6-7, 7-8, 8-9, or 9-10.

In some embodiments, the fusogen is present at a copy number of at least 1, 2, 5, or 10 copies per fusosome.

In some embodiments, the fusogen (e.g., re-targeted fusogen) comprises a Nipah virus protein G, a measles protein H, a tupaia paramyxovirus H protein, a paramyxovirus G protein, a paramyxovirus H protein, a paramyxovirus HN protein, a Morbilivirus H protein, a respirovirus HN protein, a sendai HN protein, a rubulavirus HN protein, an avulavirus HN protein, or a derivative thereof. In some embodiments, the fusogen (e.g., re-targeted fusogen) comprises a sequence chosen from Nipah virus F and G proteins, measles virus F and H proteins, tupaia paramyxovirus F and H proteins, paramyxovirus F and G proteins or F and H proteins or F and HN proteins, Hendra virus F and G proteins, Henipavirus F and G proteins, Morbilivirus F and H proteins, respirovirus F and HN protein, a Sendai virus F and HN protein, rubulavirus F and HN proteins, or avulavirus F and HN proteins, or a derivative thereof, or any combination thereof.

In some embodiments, the cargo comprises an exogenous protein or an exogenous nucleic acid. In some embodiments, the cargo comprises or encodes a cytosolic protein. In some embodiments the cargo comprises or encodes a membrane protein. In some embodiments, the cargo comprises a therapeutic agent. In some embodiments, the cargo is present at a copy number of at least 1, 2, 5, 10, 20, 50, 100, or 200 copies per fusosome (e.g., up to about 1,000 copies per fusosome). In some embodiments, the ratio of the copy number of the fusogen (e.g., re-targeted fusogen) to the copy number of the cargo is between 1000:1 and 1:1, or between 500:1 and 1:1 or between 250:1 and 1:1, or between 150:1 and 1:1, or between 100:1 and 1:1, or between 75:1 and 1:1 or between 50:1 and 1:1 or between 25:1 and 1:1 or between 20:1 and 1:1 or between 15:1 and 1:1 or between 10:1 and 1:1 or between 5:1 and 1:1 or between 2:1 and 1:1 or between 1:1 and 1:2.

In some embodiments, the fusosome composition comprises a viral capsid protein or a DNA integration polypeptide. In some embodiments, the cargo comprises a viral genome.

In some embodiments, the fusosome composition is capable of delivering a nucleic acid to a target cell, e.g., to stably modify the genome of the target cell, e.g., for gene therapy. In some embodiments, the fusosome composition does not comprise a viral nucleocapsid protein, or the amount of viral nucleocapside protein is less than 10%, 5%, 4%, 3%, 2%, 1%, 0.5%, 0.2%, or 0.1% of total protein, e.g., by mass spectrometry, e.g. using an assay of Example 93.

In embodiments, the fusosome composition comprises at least $10^5$, $10^6$, $10^7$, $10^8$, $10^9$, $10^{10}$, $10^{11}$, $10^{12}$, $10^{13}$, $10^{14}$, or $10^{15}$ fusosomes. In embodiments, the fusosome composition comprises at least 10 ml, 20 ml, 50 ml, 100 ml, 200 ml, 500 ml, 1 L, 2 L, 5 L, 10 L, 20 L, or 50 L.

In embodiments, the fusosome is from a mammalian cell having a modified genome, e.g., to reduce immunogenicity (e.g., by genome editing, e.g., to remove an MHC protein or MHC complexes). In embodiments, the source cell is from a cell culture treated with an anti-inflammatory signal. In embodiments, the method further comprises contacting the source cell of step a) with an immunosuppressive agent or anti-inflammatory signal, e.g., before or after inactivating the nucleus, e.g., enucleating the cell.

In one aspect, provided herein is a fusosome composition comprising a plurality of fusosomes derived from a source cell, wherein the fusosomes of the plurality comprise: (a) a lipid bilayer, (b) a lumen comprising cytosol, wherein the lumen is surrounded by the lipid bilayer; (c) an exogenous or overexpressed fusogen disposed in the lipid bilayer, (d) a cargo; and wherein the fusosome does not comprise a nucleus; wherein the amount of viral capsid protein in the fusosome composition is less than 1% of total protein; wherein the plurality of fusosomes, when contacted with a target cell population in the presence of an inhibitor of endocytosis, and when contacted with a reference target cell population not treated with the inhibitor of endocytosis, delivers the cargo to at least 30% of the number of cells in the target cell population compared to the reference target cell population.

In embodiments, the fusosome composition delivers the cargo to at least 40%, 50%, 60%, 70%, or 80% of the number of cells in the target cell population compared to the reference target cell population or to a non-target cell population; or delivers the cargo, e.g., at least 40%, 50%, 60%, 70%, or 80% of the cargo, to the target cell population compared to the reference target cell population or to a non-target cell population. In embodiments, less than 10% of cargo enters the cell by endocytosis. In embodiments, the inhibitor of endocytosis is an inhibitor of lysosomal acidification, e.g., bafilomycin A1. In embodiments, cargo delivered is determined using an endocytosis inhibition assay, e.g., an assay of Example 80. In embodiments, cargo enters the cell through a dynamin-independent pathway or a lysosomal acidification-independent pathway, a macropinocytosis-independent pathway (e.g., wherein the inhibitor of endocytosis is an inhibitor of macropinocytosis, e.g., 5-(N-ethyl-N-isopropyl) amiloride (EIPA), e.g., at a concentration of 25 μM), or an actin-independent pathway (e.g., wherein the inhibitor of endocytosis is an inhibitor of actin polymerization is, e.g., Latrunculin B, e.g., at a concentration of 6 μM).

Compositions of fusosomes may be generated from cells in culture, for example cultured mammalian cells, e.g., cultured human cells. The cells may be progenitor cells or non-progenitor (e.g., differentiated) cells. The cells may be primary cells or cell lines (e.g., a mammalian, e.g., human, cell line described herein). In embodiments, the cultured cells are progenitor cells, e.g., bone marrow stromal cells, marrow derived adult progenitor cells (MAPCs), endothelial progenitor cells (EPC), blast cells, intermediate progenitor cells formed in the subventricular zone, neural stem cells, muscle stem cells, satellite cells, liver stem cells, hematopoietic stem cells, bone marrow stromal cells, epidermal stem cells, embryonic stem cells, mesenchymal stem cells, umbilical cord stem cells, precursor cells, muscle precursor cells, myoblast, cardiomyoblast, neural precursor cells, glial precursor cells, neuronal precursor cells, hepatoblasts.

In some embodiments, the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial glial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell).

The cultured cells may be from epithelial, connective, muscular, or nervous tissue or cells, and combinations thereof. Fusosome can be generated from cultured cells from any eukaryotic (e.g., mammalian) organ system, for example, from the cardiovascular system (heart, vasculature); digestive system (esophagus, stomach, liver, gallbladder, pancreas, intestines, colon, rectum and anus); endocrine system (hypothalamus, pituitary gland, pineal body or pineal gland, thyroid, parathyroids, adrenal glands); excretory system (kidneys, ureters, bladder); lymphatic system (lymph, lymph nodes, lymph vessels, tonsils, adenoids, thymus, spleen); integumentary system (skin, hair, nails); muscular system (e.g., skeletal muscle); nervous system (brain, spinal cord, nerves); reproductive system (ovaries, uterus, mammary glands, testes, vas deferens, seminal vesicles, prostate); respiratory system (pharynx, larynx, trachea, bronchi, lungs, diaphragm); skeletal system (bone, cartilage), and combinations thereof. In embodiments, the cells are from a highly mitotic tissue (e.g., a highly mitotic healthy tissue, such as epithelium, embryonic tissue, bone marrow, intestinal crypts). In embodiments, the tissue sample is a highly metabolic tissue (e.g., skeletal tissue, neural tissue, cardiomyocytes).

In some embodiments, the cells are from a young donor, e.g., a donor 25 years, 20 years, 18 years, 16 years, 12 years, 10 years, 8 years of age, 5 years of age, 1 year of age, or less. In some embodiments, the cells are from fetal tissue.

In some embodiments, the cells are derived from a subject and administered to the same subject or a subject with a similar genetic signature (e.g., MHC-matched).

In certain embodiments, the cells have telomeres of average size greater than 3000, 4000, 5000, 6000, 7000, 8000, 9000, or 10000 nucleotides in length (e.g., between 4,000-10,000 nucleotides in length, between 6,000-10,000 nucleotides in length).

C. Fusogens and Pseudotyping

In some embodiments, the fusosome described herein (e.g., comprising a vesicle or a portion of a cell) includes one or more fusogens, e.g., to facilitate the fusion of the fusosome to a membrane, e.g., a cell membrane. Also these compositions may include surface modifications made during or after synthesis to include one or more fusogens. The surface modification may comprise a modification to the membrane, e.g., insertion of a lipid or protein into the membrane.

In some embodiments, the fusosomes comprise one or more fusogens on their exterior surface (e.g., integrated into the cell membrane) to target a specific cell or tissue type (e.g., a T cell). In some embodiments, the specific cell type targeted by the one or more fusogens is a T cell, optionally wherein a the T cell is a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell. Fusosomes may comprise a targeting domain. Fusogens include without limitation protein based, lipid based, and chemical based fusogens. The fusogen may bind a partner, e.g., a feature on a target cells' surface. In some embodiments the partner on a target cells' surface is a target cell moiety. In particular embodiments, a fusogen is a fusogen or a re-targeted fusogen that binds to a target cell from among a T cell, optionally wherein a the T cell is a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell. In some embodiments, the fusosome comprising the fusogen will integrate the membrane into a lipid bilayer of a target cell.

In some embodiments, one or more of the fusogens described herein may be included in the fusosome.

The fusosomes (e.g., retroviral vectors) described herein can comprise a fusogen, e.g., an endogenous fusogen or a pseudotyped fusogen.

i) Protein Fusogens

In some embodiments, the fusogen comprises a protein (e.g., glycoprotein), lipid, or small molecule. A fusogen can be, for instance, a mammalian fusogen or a viral fusogen. In some embodiments, the fusogen is a protein fusogen, e.g., a mammalian protein or a homologue of a mammalian protein (e.g., having 50%, 60%, 70%, 80%, 85%, 90%, 95%, 96%, 97%, 98%, 99%, or greater identity), a non-mammalian protein such as a viral protein or a homologue of a viral protein (e.g., having 50%, 60%, 70%, 80%, 85%, 90%, 95%, 96%, 97%, 98%, 99%, or greater identity), a native protein or a derivative of a native protein, a synthetic protein, a fragment thereof, a variant thereof, a protein fusion comprising one or more of the fusogens or fragments, and any combination thereof. In some embodiments, a viral fusogen is a Class I viral membrane fusion protein, a Class II viral membrane protein, a Class III viral membrane fusion protein, a viral membrane glycoprotein, or other viral fusion proteins, or a homologue thereof, a fragment thereof, a variant thereof, or a protein fusion comprising one or more proteins or fragments thereof.

In embodiments, the fusogen is a viral fusogen, e.g., HA, HIV-1 ENV, HHV-4, gp120, or VSV-G. In embodiments, the fusogen is a mammalian fusogen, e.g., a SNARE, a Syncytin, myomaker, myomixer, myomerger, or FGFRL1. In embodiments, the fusogen is active at a pH of 4-5, 5-6, 6-7, 7-8, 8-9, or 9-10. In embodiments, the fusogen is not active at a pH of 4-5, 5-6, 6-7, 7-8, 8-9, or 9-10. In embodiments, the fusosome fuses to a target cell at the surface of the target cell. In embodiments, the fusogen promotes fusion in a lysosome-independent manner. In embodiments, the fusogen is a protein fusogen. In embodiments, the fusogen is a lipid fusogen, e.g., oleic acid, glycerol mono-oleate, a glyceride, diacylglycerol, or a modified unsaturated fatty acid. In embodiments, the fusogen is a chemical fusogen, e.g., PEG. In embodiments, the fusogen is a small molecule fusogen, e.g., halothane, an NSAID such as meloxicam, piroxicam, tenoxicam, and chlorpromazine. In embodiments, the fusogen is recombinant. In embodiments, the fusogen is biochemically incorporated, e.g., the fusogen is provided as a purified protein and contacted with a lipid bilayer under conditions that allow for associate of the fusogen with the lipid bilayer. In embodiments, the fusogen is biosynthetically incorporated, e.g. expressed in a source cell under conditions that allow the fusogen to associate with the lipid bilayer.

In some embodiments, the fusogen (e.g., re-targeted fusogen) comprises a mammalian fusogen. In some embodiments, the fusogen (e.g., re-targeted fusogen) comprises a viral fusogen. In some embodiments, the fusogen (e.g., re-targeted fusogen) is a protein fusogen. In some embodiments, the fusogen (e.g., re-targeted fusogen) comprises a sequence chosen from a Nipah virus protein F, a measles virus F protein, a tupaia paramyxovirus F protein, a paramyxovirus F protein, a Hendra virus F protein, a Henipavirus F protein, a Morbilivirus F protein, a respirovirus F protein, a Sendai virus F protein, a rubulavirus F protein, or an avulavirus F protein, or a derivative thereof.

In some embodiments, the fusogen (e.g., re-targeted fusogen) is active at a pH of 4-5, 5-6, 6-7, 7-8, 8-9, or 9-10. In some embodiments, the fusogen (e.g., re-targeted fusogen) is not active at a pH of 4-5, 5-6, 6-7, 7-8, 8-9, or 9-10.

In some embodiments, the fusogen is present at a copy number of at least 1, 2, 5, or 10 copies per fusosome.

In some embodiments, the fusogen (e.g., re-targeted fusogen) comprises a Nipah virus protein G, a measles protein H, a tupaia paramyxovirus H protein, a paramyxovirus G protein, a paramyxovirus H protein, a paramyxovirus HN protein, a Morbilivirus H protein, a respirovirus HN protein, a sendai HN protein, a rubulavirus HN protein, an avulavirus HN protein, or a derivative thereof. In some embodiments, the fusogen (e.g., re-targeted fusogen) comprises a sequence chosen from Nipah virus F and G proteins, measles virus F and H proteins, tupaia paramyxovirus F and H proteins, paramyxovirus F and G proteins or F and H proteins or F and HN proteins, Hendra virus F and G proteins, Henipavirus F and G proteins, Morbilivirus F and H proteins, respirovirus F and HN protein, a Sendai virus F and HN protein, rubulavirus F and HN proteins, or avulavirus F and HN proteins, or a derivative thereof, or any combination thereof.

Non-mammalian fusogens include viral fusogens, homologues thereof, fragments thereof, and fusion proteins comprising one or more proteins or fragments thereof. Viral fusogens include class I fusogens, class II fusogens, class III fusogens, and class IV fusogens. In embodiments, class I fusogens such as human immunodeficiency virus (HIV) gp41, have a characteristic postfusion conformation with a signature trimer of α-helical hairpins with a central coiled-coil structure. Class I viral fusion proteins include proteins having a central postfusion six-helix bundle. Class I viral fusion proteins include influenza HA, parainfluenza F, HIV Env, Ebola GP, hemagglutinins from orthomyxoviruses, F proteins from paramyxoviruses (e.g. Measles, (Katoh et al. BMC Biotechnology 2010, 10:37)), ENV proteins from retroviruses, and fusogens of filoviruses and coronaviruses. In embodiments, class II viral fusogens such as dengue E glycoprotein, have a structural signature of β-sheets forming an elongated ectodomain that refolds to result in a trimer of hairpins. In embodiments, the class II viral fusogen lacks the central coiled coil. Class II viral fusogen can be found in alphaviruses (e.g., E1 protein) and flaviviruses (e.g., E glycoproteins). Class II viral fusogens include fusogens from Semliki Forest virus, Sinbis, rubella virus, and dengue virus. In embodiments, class III viral fusogens such as the vesicular stomatitis virus G glycoprotein, combine structural signatures found in classes I and II. In embodiments, a class III viral fusogen comprises a helices (e.g., forming a six-helix bundle to fold back the protein as with class I viral fusogens), and β sheets with an amphiphilic fusion peptide at its end, reminiscent of class II viral fusogens. Class III viral fusogens can be found in rhabdoviruses and herpesviruses. In embodiments, class IV viral fusogens are fusion-associated small transmembrane (FAST) proteins (doi: 10.1038/sj.emboj.7600767, Nesbitt, Rae L., "Targeted Intracellular Therapeutic Delivery Using Liposomes Formulated with Multifunctional FAST proteins" (2012). Electronic Thesis and Dissertation Repository. Paper 388), which are encoded by nonenveloped reoviruses. In embodiments, the class IV viral fusogens are sufficiently small that they do not form hairpins (doi:10.1146/annurev-cellbio-101512-122422, doi:10.1016/j.devcel.2007.12.008).

Fusogens, which include viral envelope proteins (env), generally determine the range of host cells which can be infected and transformed by fusosomes. In the case of lentiviruses, such as HIV-1, HIV-2, SIV, FIV and EIV, the native env proteins include gp41 and gp120. In some embodiments, the viral env proteins expressed by source cells described herein are encoded on a separate vector from the viral gag and pol genes, as has been previously described.

Illustrative examples of retroviral-derived env genes which can be employed include, but are not limited to: MLV envelopes, 10A1 envelope, BAEV, FeLV-B, RD114, SSAV, Ebola, Sendai, FPV (Fowl plague virus), and influenza virus envelopes. Similarly, genes encoding envelopes from RNA viruses (e.g., RNA virus families of Picornaviridae, Calciviridae, Astroviridae, Togaviridae, Flaviviridae, Coronaviridae, Paramyxoviridae, Rhabdoviridae, Filoviridae, Orthomyxoviridae, Bunyaviridae, Arenaviridae, Reoviridae, Birnaviridae, Retroviridae) as well as from the DNA viruses (families of Hepadnaviridae, Circoviridae, Parvoviridae, Papovaviridae, Adenoviridae, Herpesviridae, Poxyiridae, and Iridoviridae) may be utilized. Representative examples include, FeLV, VEE, HFVW, WDSV, SFV, Rabies, ALV, BIV, BLV, EBV, CAEV, SNV, ChTLV, STLV, MPMV, SMRV, RAV, FuSV, MH2, AEV, AMV, CT10, and EIAV.

In some embodiments, envelope proteins for display on a fusosome include, but are not limited to any of the following sources: Influenza A such as H1N1, H1N2, H3N2 and H5N1 (bird flu), Influenza B, Influenza C virus, Hepatitis A virus, Hepatitis B virus, Hepatitis C virus, Hepatitis D virus, Hepatitis E virus, Rotavirus, any virus of the Norwalk virus group, enteric adenoviruses, parvovirus, Dengue fever virus, Monkey pox, Mononegavirales, Lyssavirus such as rabies virus, Lagos bat virus, Mokola virus, Duvenhage virus, European bat virus 1 & 2 and Australian bat virus, Ephemerovirus, Vesiculovirus, Vesicular Stomatitis Virus (VSV), Herpesviruses such as Herpes simplex virus types 1 and 2, varicella zoster, cytomegalovirus, Epstein-Bar virus (EBV), human herpesviruses (HHV), human herpesvirus type 6 and 8, Human immunodeficiency virus (HIV), papilloma virus, murine gammaherpesvirus, Arenaviruses such as Argentine hemorrhagic fever virus, Bolivian hemorrhagic fever virus, Sabia-associated hemorrhagic fever virus, Venezuelan hemorrhagic fever virus, Lassa fever virus, Machupo virus, Lymphocytic choriomeningitis virus (LCMV), Bunyaviridiae such as Crimean-Congo hemorrhagic fever virus, Hantavirus, hemorrhagic fever with renal syndrome causing virus, Rift Valley fever virus, Filoviridae (filovirus) including Ebola hemorrhagic fever and Marburg hemorrhagic fever, Flaviviridae including Kaysanur Forest disease virus, Omsk hemorrhagic fever virus, Tick-borne encephalitis causing virus and Paramyxoviridae such as Hendra virus and Nipah virus, variola major and variola minor (smallpox), alphaviruses such as Venezuelan equine encephalitis virus, eastern equine encephalitis virus, western equine encephalitis virus, SARS-associated coronavirus (SARS-COV), West Nile virus, any encephaliltis causing virus.

In some embodiments, a source cell described herein produces a fusosome, e.g., recombinant retrovirus, e.g., lentivirus, pseudotyped with the VSV-G glycoprotein.

A fusosome or pseudotyped virus generally has a modification to one or more of its envelope proteins, e.g., an envelope protein is substituted with an envelope protein from another virus. For example, HIV can be pseudotyped with a fusion protein from rhabdovirus, e.g., vesicular stomatitis virus G-protein (VSV-G) envelope proteins, which allows HIV to infect a wider range of cells because HIV envelope proteins (encoded by the env gene) normally target the virus to CD4+ presenting cells. In some embodiments, lentiviral envelope proteins are pseudotyped with VSV-G. In one embodiment, source cells produce recombinant retrovirus, e.g., lentivirus, pseudotyped with the VSV-G envelope glycoprotein.

Furthermore, a fusogen or viral envelope protein can be modified or engineered to contain polypeptide sequences that allow the transduction vector to target and infect host cells outside its normal range or more specifically limit transduction to a cell or tissue type. For example, the fusogen or envelope protein can be joined in-frame with targeting sequences, such as receptor ligands, antibodies (using an antigen-binding portion of an antibody or a recombinant antibody-type molecule, such as a single chain antibody), and polypeptide moieties or modifications thereof (e.g., where a glycosylation site is present in the targeting sequence) that, when displayed on the transduction vector coat, facilitate directed delivery of the virion particle to a target cell of interest. Furthermore, envelope proteins can further comprise sequences that modulate cell function. Modulating cell function with a transducing vector may increase or decrease transduction efficiency for certain cell types in a mixed population of cells. For example, stem cells could be transduced more specifically with envelope sequences containing ligands or binding partners that bind specifically to stem cells, rather than other cell types that are found in the blood or bone marrow. Non-limiting examples are stem cell factor (SCF) and Flt-3 ligand. Other examples include, e.g., antibodies (e.g., single-chain antibodies that are specific for a cell-type), and essentially any antigen (including receptors) that binds tissues as lung, liver, pancreas, heart, endothelial, smooth, breast, prostate, epithelial, vascular cancer, etc.

Protein fusogens or viral envelope protein may be re-targeted by mutating amino acid residues in a fusion protein or a targeting protein (e.g. the hemagglutinin protein). In some embodiments the fusogen is randomly mutated. In some embodiments the fusogen is rationally mutated. In some embodiments the fusogen is subjected to directed evolution. In some embodiments the fusogen is truncated and only a subset of the peptide is used in the retroviral vector or VLP. For example, amino acid residues in the measles hemagglutinin protein may be mutated to alter the binding properties of the protein, redirecting fusion (doi: 10.1038/nbt942, Molecular Therapy vol. 16 no. 8, 1427-1436 Aug. 2008, doi:10.1038/nbt1060, DOI: 10.1128/JVI.76.7.3558-3563.2002, DOI: 10.1128/JVI.75.17.8016-8020.2001, doi: 10.1073pnas.0604993103).

In some embodiments, the protein fusogen or viral envelope protein is re-targeted by i) mutating amino acid resides in the natural fusogen protein sequence or viral envelope protein sequence and/or ii) engineering the fusogen protein or viral envelope protein to contain polypeptide sequences that allow the fusogen or viral envelope protein to target and fuse or infect host cells outside its normal range.

In some embodiments, the fusosomes comprise one or more fusogens on their exterior surface (e.g., integrated into the cell membrane) to target a specific cell or tissue type. Fusogens include without limitation protein based, lipid based, and chemical based fusogens. The fusogen may bind a partner on a target cells' surface. In some embodiments, the fusosome comprising the fusogen will integrate the membrane into a lipid bilayer of a target cell.

In some embodiments the fusogen is a paramyxovirus fusogen. In some embodiments the fusogen is a Nipah virus protein F, a measles virus F protein, a tupaia paramyxovirus F protein, a paramyxovirus F protein, a Hendra virus F protein, a Henipavirus F protein, a Morbilivirus F protein, a respirovirus F protein, a Sendai virus F protein, a rubulavirus F protein, or an avulavirus F protein.

In some embodiments, the fusogen is a poxviridae fusogen.

Additional exemplary fusogens are disclosed in U.S. Pat. No. 9,695,446, US 2004/0028687, U.S. Pat. Nos. 6,416,997, 7,329,807, US 2017/0112773, US 2009/0202622, WO 2006/027202, and US 2004/0009604, the entire contents of all of which are hereby incorporated by reference.

In some embodiments, a fusogen described herein comprises an amino acid sequence of Table 1, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to any amino acid sequence of Table 1. In some embodiments, a nucleic acid sequence described herein encodes an amino acid sequence of Table 1, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

In some embodiments, a fusogen described herein comprises an amino acid sequence set forth in any one of SEQ ID NOS: 1-57, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to an amino acid sequence set forth in any one of SEQ ID NOS: 1-57. In some embodiments, a nucleic acid sequence described herein encodes an amino acid sequence set forth in any one of SEQ ID NOS: 1-57, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

TABLE 1

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

<table>
<tr><th>Genbank ID</th><th>Nucleotides of CDS</th><th>Full Gene Name</th><th>Sequence</th><th>#Sequences/ Cluster</th><th>SEQ ID NO</th></tr>
<tr><td>KP317927</td><td>5630-7399</td><td>gb:KP317927:5630-7399|Organism:Human respiratory syncytial virus|Strain Name: Kilifi_9465_7_RSVB_2011|Protein Name:fusion glycoprotein|Gene Symbol:F</td><td>MIPQARTELNLGQITMELLIHRSSAIFLT<br>LAINALYLTSSQNITEEFYQSTCSAVSRG<br>YLSALRTGWYTSVITIELSNIKETKCNG<br>TDTKVKLIKQELDKYKNAVTELQLLMQ<br>NTPAANNRARREAPQYMNYTINTTGSL<br>NVSISKKRKRRFLGFLLGVGSAIASGIA<br>VSKVLHLEGEVNKIKNALLSTNKAVVS<br>LSNGVSVLTSKVLDLKNYINNQLLPIVN<br>QQSCRISNIETVIEFQQKNSRLLEITREFS<br>VNAGVTTPLSTYMLTNSELLSLINDMPI<br>TNDQKKLMSSNVQIVRQQSYSIMSIIKE<br>EVLAYVVQLPIYGVIDTPCWKLHTSPLC<br>TTNIKEGSNICLTRTDRGWYCDNAGSV<br>SFFPQADTCKVQSNRVFCDTMNSLTLPS<br>EVSLCNTDIFNSKYDCKIMTSKTDISSSV<br>ITSLGAIVSCYGKTKCTASNKNRGIIKTF<br>SNGCDYVSNKGVDTVSVGNTLYYVNK<br>LEGKNLYVKGEPIINYYDPLVFPSDEFD<br>ASISQVNEKINQSLAFIRRSDELLHNVNT<br>GKSTTNIMITAIIIVIIVVLLSLIAIGLLLY<br>CKAKNTPVTLSKDQLSGINNIAFSK</td><td>993</td><td>1</td></tr>
<tr><td>AB524405</td><td>4556-6217</td><td>gb:AB524405:4556-6217|Organism:Newcastle disease virus|Strain Name:Goose/ Alaska/</td><td>MDPKPSTSYLHAFPLIFVAISLVFMAGR<br>ASALDGRPLAAAGIVVTGDKAVNIYTS<br>SQTGTIIIKLLPNMPKDKEQCAKSPLDA<br>YNRTLTTLLAPLGDSIRRIQESVTTSGGE<br>RQERLVGAIIGGVALGVATAAQITAAS<br>ALIQANQNAANILKLKESIAATNEAVHE</td><td>418</td><td>2</td></tr>
</table>

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

<table>
<tr><th>Genbank ID</th><th>Nucleotides of CDS</th><th>Full Gene Name</th><th>Sequence</th><th>#Sequences/ Cluster</th><th>SEQ ID NO</th></tr>
<tr><td></td><td></td><td>415/91|Protein Name:fusion protein|Gene Symbol:F</td><td>VTSGLSQLAVAVGKMQQFVNDQFNKTAQEIDCIKITQQVGVELNLYLTELTTVFGPQITSPALTQLTIQALYNLAGGNMDYMLTKLGVGNNQLSSLISSGLISGNPILYDSQTQLLGIQVTLPSVGNLNNMRATYLETLSVSTNKGFASALVPKVVTQVGSVIEELDTSYCIETDLDLYCTRIVTFPMSPGIFSCLGGNTSACMYSKTEGALTTPYMTLKGSVIANCKMTTCRCADPPGIISQNYGEAVSLIDKKVCNILTLDGITLRLSGEFDATYQKNISIQDSQVVITGNLDISTELGNVNNSISNALDKLEESNSKLDKVNVRLTSTSALITYIVLTTIALICGIVSLVLACYIMYKQKAQQKTLLWLGNNTLDQMRATTKM</td><td></td><td></td></tr>
<tr><td>AF266286</td><td>4875-7247</td><td>gb:AF266286:4875-7247|Organism:Measles virus strain AIK-C|Strain Name:Measles virus strain Edmonston (AIK-C vaccine)|Protein Name:fusion protein|Gene Symbol:F</td><td>MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGYTKSCARTLVSGSFGNRFILSQGNLIANCASILCKCYTTGTIINQDPDKILTYIAADNCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL</td><td>128</td><td>3</td></tr>
<tr><td>AB503857</td><td>3068-4687</td><td>gb:AB503857:3068-4687|Organism:Human metapneumovirus|Strain Name:Jpn03-1|Protein Name:fusion glycoprotein precursor|Gene Symbol:F</td><td>MSWKVVIIFSLLITPQHGLKESYLEESCSTITEGYLSVLRTGWYTNVFTLEVGDVENLTCSDGPSLIKTELDLTKSALRELKTVSADQLAREEQIEKPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS</td><td>125</td><td>4</td></tr>
<tr><td>EU277658</td><td>5078-6700</td><td>gb:EU277658:5078-6700|Organism:Bovine parainfluenza virus 3|Strain Name:Q5592|Protein Name:fusion protein|Gene Symbol:F</td><td>MIIIVITMILSLTPSSLCQIDITKLQSVGVLVNSPKGIKISQNFETRYLILSLIPKIEDSHSCGNQQIDQYKKLLDRLIIPLYDGLKLQKDVIVVNHESHNNTNLRTKRFFGEIIGTIAIGIATSAQITAAVALVEAKQARSDIDKLKEAIKDTNKAVQSIQSSVGNLIVAVKSVQDYVNNEIVPSITRLGCEAAGLQLGIALTQHYSELTNIFGDNIGTLGEKGVKLQGIASLYRTNITEVFTTSTVDQYDIYDLLFTESIKMRVIDVDLSDYSITLQVRLPLLTKVSNTQIYKVDSISYNIQGKEWYIPLPHHIMTKGAFLGGADIKECIESFSNYICPSDP</td><td>93</td><td>5</td></tr>
</table>

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | GFILNHEMENCLSGNITQCPKTIVTSDIV PRYAFVDGGVIANCIPTTCTCNGIDNRI NQSPDQGIKIITYKECQIVGINGMLFKTN QEGTLAKYTFDNIKLNNSVALNPIDISL ELNKAKSDLEESKRWIEKSNQKLDSIGS WHQSSVTIIIIIVMIVVLLIINAIIIMIMIRY LRDRNRHLNNKDSEPYVLTNRQ | | |
| AB040874 | 4546-6162 | gb:AB040874:4546-6162\|Organism:Mumps virus\|Strain Name:Miyahara\|Protein Name:fusion protein\|Gene Symbol:F | MKVFLVTCLGFAVFSSSVCVNINILQQI GYIKQQVRQLSYYSQSSSSYIVVKLLPN IQPTDNSCEFKSVTQYNKTLSNLLLPIAE NINNIASPSSGSRRHKRFAGIAIGIAALG VATAAQVTAAVSLVQAQTNARAIAAM KNSIQATNRAVFEVKEGTQRLAIAVQAI QDHINTIMNTQLNNMSCQILDNQLATS LGLYLTELTTVFQPQLINPALSPISIQAL RSLLGSMTPAVVQATLSTSISAAEILSA GLMEGQIVSVLLDEMQMIVKINIPTIVT QSNALVIDFYSISSFINNQESIIQLPDRILE IGNEQWSYPAKNCKLTRHHIFCQYNEA ERLSLESKLCLAGNISACVFSPIAGSYM RRFVALDGTIVANCRSLTCLCKSPSYPI YQPDHHAVTTIDLTACQTLSLDGLDFSI VSLSNITYAENLTISLSQTINTQPIDISTE LSKVNASLQNAVKYIKESNHQLQSVNV NSKIGAIIVAALVLSILSIIISLLFCCWAY VATKEIRRINFKTNHINTISSSVDDLIRY | 89 | 6 |
| AB475097 | 4908-6923 | gb:AB475097:4908-6923\|Organism:Canine distemper virus\|Strain Name:M25CR\|Protein Name:fusion protein\|Gene Symbol:F | MNPHEQTIPMHEKIPKRSKTQTHTQQD LPQQHSTKSAESKTSRARHSITSAQRST HYDPRTADWPDYYIMKRTRSCKQASY RSDNIPAHGDHDGIIHHTPESVSQGAKS RLKMGQSNAVKSGSQCTWLVLWCIGV ASLFLCSKAQIHWNNLSTIGIIGTDSVHY KIMTRPSHQYLVIKLMPNVSLIDNCTKA ELDEYEKLLSSILEPINQALTLMTKNVK PLQSVGSGRRQRRFAGVVLAGAALGV ATAAQITAGIALHQSNLNAQAIQSLRTS LEQSNKAIEEIREATQETVIAVQGVQDY VNNELVPAMQHMSCELVGQRLGLKLL RYYTELLSIFGPSLRDPISAEISIQALSYA LGGEIHKILEKLGYSGNDMIAILESRGIK TKITHVDLPGKFIILSVSYPTLSEVKGVI VHRLEAVSYNIGSQEWYTTVPRYVATN GYLISNFDESSCVFVSESAICSQNSLYPM SPLLQQCIRGDTSSCARTLVSGTMGNKF ILSKGNIVANCASILCKCYSTSTIINQSPD KLLTFIASDTCPLVEIDGVTIQVGSRQYP DMVYESKVALGPAISLERLDVGTNLGN ALKKLDDAKVLIDSSNQILETVRRSSFN FGSLLSVPILSCTALALLLLICCCKRRYQ QTHKQNTKVDPTFKPDLTGTSRSYVRSL | 46 | 7 |
| AJ849636 | 5526-7166 | gb:AJ849636:5526-71661\|Organism:Peste-des-petits-ruminants virus\|Strain Name:Turkey 2000\|Protein Name:fusion protein\|Gene Symbol:F | MTRVAILTFLFLFPNAVACQIHWGNLS KIGIVGTGSASYKVMTRPSHQTLVIKLM PNITAIDNCTKSEIAEYKRLLITVLKPVE DALSVITKNVRPIQTLTPGRRTRRFAGA VLAGVALGVATAAQITAGVALHQSLM NSQAIESLKTSLEKSNQAIEEIRLANKET ILAVQGVQDYINNELVPSVHRMSCELV GHKLGLKLLRYYTEILSIFGPSLRDPIAA EISIQALSYALGGDINRILDKLGYSGGDF LAILESKGIKARVTYVDTRDYFIILSIAY PTLSEIKGVIVHKIEAITYNIGAQEWYTT IPKYVATQGYLISNFDETSCVFTPDGTV CSQNALYPMSPLLQECFQGSTKSCART LVSGTISNRFILSKGNLIANCASVLCKCY TTETVISQDPDKLLTVVASDKCPVVEV DGVTIQVGSREYPDSVYLHKIDLGPAIS | 34 | 8 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | LEKLDVGTNLGNAVTRLENAKELLDAS DQILKTVKGVPFGGNMYIALAACIGVS LGLVTLICCCKGRCKNKEVPISKINPGL KPDLTGTSKSYVRSL | | |
| AF017149 | 6618-8258 | gb:AF0171491\|Organism:Hendra virus\|Strain Name:UNKNOWN-AF017149\|Protein Name:fusion\|Gene Symbol:F | MATQEVRLKCLLCGIIVLVLSLEGLGIL HYEKLSKIGLVKGITRKYKIKSNPLTKDI VIKMIPNVSNVSKCTGTVMENYKSRLT GILSPIKGAIELYNNNTHDLVGDVKLAG VVMAGIAIGIATAAQITAGVALYEAMK NADNINKLKSSIESTNEAVVKLQETAEK TVYVLTALQDYINTNLVPTIDQISCKQT ELALDLALSKYLSDLLFVFGPNLQDPVS NSMTIQAISQAFGGNYETLLRTLGYATE DFDDLLESDSIAGQIVYVDLSSYYIIVRV YFPILTEIQQAYVQELLPVSFNNDNSEW ISIVPNFVLIRNTLISNIEVKYCLITKKSVI CNQDYATPMTASVRECLTGSTDKCPRE LVVSSHVPRFALSGGVLFANCISVTCQC QTTGRAISQSGEQTLLMIDNTTCTTVVL GNIIISLGKYLGSINYNSESIAVGPPVYT DKVDISSQISSMNQSLQQSKDYIKEAQK ILDTVNPSLISMLSMIILYVLSIAALCIGL ITFISFVIVEKKRGNYSRLDDRQVRPVS NGDLYYIGT | 29 | 9 |
| AB005795 | 4866-6563 | gb:AB005795:4866-6563\|Organism:Sendai virus\|Strain Name:Ohita\|Protein Name:fusion protein\|Gene Symbol:F | MATYIQRVQCISALLSVVLTTLVSCQIP RDRLSNIGVIVDEGKSLKIAGSHESRYIV LSLVPGIDLENGCGTAQVIQYKSLLNRL LIPLRDALDLQEALITVTNDTMTGADVP QSRFFGAVIGTIALGVATSAQITAGIALA EAREAKRDIALIKESMTKTHKSIELLQN AVGEQILALKTLQDFVNDEIKPAISELG CETAALRLGIKLTQHYSELLTAFGSNFG TIGEKSLTLQALSSLYSANITEIMTTIRT GQSNIYDVIYTEQIKGTVIDVDLERYMV TLSVKIPILSEVPGVLIHKASSISYNIDGE EWYVTVPSHILSRASFLGGANIADCVES RLTYICPRDPAQLIPDSQQKCILGDTTRC PVTKVVDNIIPKFAFVNGGVVANCIAST CTCGTGRRPISQDRSKGVVFLTHDNCG LIGVNGIELYANRKGHDATWGVQNLT VGPAIAIRPVDISLNLAAATDFLQDSRA ELEKARKILSEVGRWYNSGATLITIIVV MIVVLVVIIVIVIVLYRLRRSMLMSNPA GRISRDTYTLEPKIRHMYTNGGFDAMT EKR | 23 | 10 |
| AF457102 | 5088-6755 | gb:AF4571021\|Organism:Human parainfluenza virus 1 strain Washington/1964\|Strain Name:Washington 1964\|Protein Name:F glycoprotein\|Gene Symbol:F | MQKSEILFLVYSSLLLSSSLCQIPVEKLS NVGVIINEGKLLKIAGSYESRYIVLSLVP SIDLQDGCGTTQIIQYKNLLNRLLIPLKD ALDLQESLITITNDTTVTNDNPQTRFFG AVIGTIALGVATAAQITAGIALAEAREA RKDIALIKDSIVKTHNSVELIQRGIGEQII ALKTLQDFVNDEIRPAIGELRCETTALK LGIKLTQHYSELATAFSSNLGTIGEKSLT LQALSSLYSANITEILSTTKKDKSDIYDII YTEQVKGTVIDVDLEKYMVTLLVKIPIL SEIPGVLIYRASSISYNIEGEEWHVAIPN YIINKASSLGGADVTNCIESKLAYICPRD PTQLIPDNQQKCILGDVSKCPVTKVINN LVPKFAFINGGVVANCIASTCTCGTNRI PVNQDRSRGVTFLTYTNCGLIGINGIEL YANKRGRDTTWGNQIIKVGPAVSIRPV DISLNLASATNFLEESKTELMKARAIISA VGGWHNTESTQIIMIIIVCILIIIICGILYY LYRVRRLLVMINSTHNSPVNAYTLESR MRNPYMGNNSN | 21 | 11 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| AB910309 | 4951-6582 | gb:AB910309:4951-65821\|Organism:Feline morbillivirus\|Strain Name:SS1\|Protein Name:fusion protein\|Gene Symbol:F | MGKIRVIIISSLLLSNITTAQVGWDNLTSIGVISTKQYDYKITTLNTNQLMVIKMVPNISSIINCTKPELMKYRELVLGVIRPINESLELMNSYINMRAGSERFIGAVIAGVALGVATAAQITSGIALHNSIMNKRQIQELRKALSTTNKAIDEIRIAGERTLIAVQGVQDYINNIIIPMQDKLQCDILSSQLAIALLRYYTNILTVFGPSIRDPVTSIISIQALSQAFNGNLQALLDGLGYTGRDLRDLLESRSITGQIIHADMTDLFLVLRINYPSITEMQGVTIYELNSITYHIGPEEWYTIMPNFIAVQGFLTSNFDERKCSITKSSILCQQNSIYPMSTEMQRCIKGEIRFCPRSKAVGTLVNRFILTKGNLMANCLGVICRCYSSGQIITQDPSKLITIISQEECKEVGVDGIRIMVGPRKLPDVIFNARLEVGVPISLSKLDVGTDLAIASAKLNNSKALLEQSDKILDSMSKLDSINSRITGLILAIMAIFIITVTIIWIIYKRCRNKDNKFSTSIEPLYIPPSYNSPHSVVKSI | 12 | 12 |
| KT071755 | 4310-6070 | gb:KT071755:4310-6070\|Organism:Avian paramyxovirus 2\|Strain Name:APMV-2/Procarduelis nipalensis/China/Suiling/53/2013\|Protein Name:fusion protein\|Gene Symbol:F | MIAALFISLFATCGALDNSVLAPVGIASAQEWQLAAYTNTLSGTIAVRFVPVLPGNLSTCAQATLAEYNKTVTNILGPLKENLETLLSEPTKTAARFVGAIIGTVALGVATSAQITAAVALNQAQENARNIWRLKESIRKTNEAVLELKDGLASTAIALDKVQKFINEDIIPQIKEIDCQVVANKLGVYLSLYLTELTTIFGAQITNPALTPLSYQALYNLCGGDMGKLTELIGVKAKDINSLYEANLITGQVIGYDSESQIILIQVSYPSVSEVTGVRATELVTVSVTTPKGEGRAIAPKYVAQSRVVTEELDTSTCRFSKTTLYCRSIITRPLPPLIANCLNGLYQDCQYTTEIGALSSRFITVNGGIIANCRATICKCVNPPKIIVQSDASSLTVIDSAICKDVVLDNVQLRLEGKLSAQYFTNITIDLSQITTSGSLDISSEIGSINNTVNKVEELIAESNAWLQAVNPHLVNNTSIIVLCVLAAIFVVWLVALTGCLAYYIKKSSATRMVGIGSSPAGNPYVAQSATKM | 12 | 13 |
| AY029299 | 4598-6265 | gb:AY029299\|Organism:Avian paramyxovirus 6\|Strain Name:APMV-6/duck/Taiwan/Y1/98\|Protein Name:fusion protein\|Gene Symbol:F | MGARLGPLAMAPGRYVIIFNLILLHRVVSLDNSRLLQQGIMSATEREIKVYTNSITGSIAVRLIPNLPQEVLKCSAGQIKSYNDTLNRIFTPIKANLERLLATPSMLEDNQNPAPEPRLIGAIIGTAALGLATAAQVTAALALNQAQDNAKAILNLKESITKTNEAVLELKDATGQIAIALDKTQRFINDNILPAINNLTCEVAGAKVGVELSLYLTELSTVFGSQITNPALSTLSIQALMSLCGNDFNYLLNLMGAKHSDLGALYEANLINGRIIQYDQASQIMVIQVSVPSISSISGLRLTELFTLSIETPVGEGKAVVPQFVVESGQLLEEIDTQACTLTDTTAYCTIVRTKPLPPELVAQCLRGDESRCQYTTGIGMLESRFGVFDGLVIANCKATICRCLAPEMIITQNKGLPLTVISQETCKRILIDGVTLQIEAQVSGSYSRNITVGNSQIAPSGPLDISSELGKVNQSLSNVEDLIDQSNQLLNRVNPNIVNNTAIIVTIVLLVLLVLWCLALTISILYVSKHAVRMIKTVPNPYVMQAKSPGSATQF | 11 | 14 |
| AY141760 | 5028-6665 | gb:AY141760\|Organism:Fer-de-Lance paramyxovirus\|Strain Name:ATCC VR-895\|Protein Name:fusion protein | MTRITILQIILTLTLPVMCQVSFDNLEQVGVMFDKPKFLKITGPASTATMIIKLIPTLGTMESCGTSAVNEYKKTLDTILVPLRDTINKLSTDITVVEGTSNISNKREKRFVGIAIAVGAVALATSAQITAGIALSNTIKNAEAIESIKSSIQASNQAIQKVIDAQGRTVTVINGIQDHINSVINPALNQLGCDVAKNTLAISLTQYFSKLSLLFGPNLRNPVEQPLS | 8 | 15 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | F\|Gene Symbol:F | VQAIAGLMDGDINAVVSQLGYTQSDLL DLLSTESIVGTVTAIDMVNYMIQIEMSF PQYITIPDTKVLEGHKITFNDKGSEWQT QVPSTIAVRDILIAGVDPDGCSITSTSYIC KNDPTYAMSEVLTNCFRGNTQECPRAR ITSTFATRFAIARSTVIANCVAAVCLCG DPGIPVVQKAEVTLTAMTLDQCSLITVD GLQIKPSKSIANVTANFGNITLGPVVSV GDLDLSAELTKVQSDLKEAQDKLDESN AILQGINNKILTAPTSIALIVVSVVVILLII GMISWLVWLTKAVRRSNTRSERVTPSA YNNLGFIK | | |
| EU877976 | 4330-6410 | gb:EU877976:4330-6410\| Organism:Avian paramyxovirus 4\|Strain Name:APMV-4/KR/YJ/06\| Protein Name:fusion protein\|Gene Symbol:F | MRLSRTILTLILGTLTGYLMGAHSTNVN EGPKSEGIRGDLIPGAGIFVTQVRQLQIY QQSGYHDLVIRLLPLLPAELNDCQREV VTEYNNTVSQLLQPIKTNLDTLLADGG TRDADIQPRFIGAIIATGALAVATVAEV TAAQALSQSKTNAQNILKLRDSIQATN QAVFEISQGLEATATVLSKLQTELNENII PSLNNLSCAAMGNRLGVSLSLYLTLMT TLFGDQITNPVLTPISYSTLSAMAGGHIG PVMSKILAGSVTSQLGAEQLIASGLIQS QVVGYDSQYQLLVIRVNLVRIQEVQNT RVVSLRTLAVNRDGGLYRAQVPPEVVE RSGIAERFYADDCVLTTTDYICSSIRSSR LNPELVKCLSGALDSCTFERESALLSTP PPVYNKAVVANCKAATCRCNKPPSIIA QYSASALVTITTDTCADLEIEGYRFNIQT ESNSWVAPNFTVSTSQIVSVDPIDISSDI AKINSSIEAAREQLELSNQILSRINPRIVN DESLIAIIVTIVVLSLLVIGLIVVLGVMY KNLKKVQRAQAAMMMQQMSSSQPVT TKLGTPF | 8 | 16 |
| AB176531 | 4793-6448 | gb:AB176531:4793-6448\| Organism:Human parainfluenza virus 2\|Strain Name:Nishio\| Protein Name:fusion protein\|Gene Symbol:F | MHHLHPMIVCIFVMYTGIVGSDAIAGD QLLNIGVIQSKIRSLMYYTDGGASFIVV KLLPNLPPSNGTCNITSLDAYNVTLFKL LTPLIENLSKISTVTDTKTRQKRFAGVV VGLAALGVATAAQITAAVAIVKANAN AAAINNLASSIQSTNKAVSDVIDASRTIA TAVQAIQDRINGAIVNGITSASCRAHDA LIGSILNLYLTELTTIFHNQITNPALTPLSI QALRILLGSTLPIVIESKLNTNFNTAELL SSGLLTGQIISISPMYMQMLIQINVPTFI MQPGAKVIDLIAISANHKLQEVVVQVP NRILEYANELQNYPANDCVVTPNSVFC RYNEGSPIPESQYQCLRGNLNSCTFTPII GNFLKRFAFANGVLYANCKSLLCRCAD PPHVVSQDDTQGISIIDIKRCSEMMLDTF SFRITSTFNATYVTDFSMINANIVHLSPL DLSNQINSINKSLKSAEDWIADSNFFAN QARTAKTLYSLSAIALILSVITLVVVGLL IAYIIKLVSQIHQFRSLAATTMFHRENPA PPSKNNHGNIYGIS | 7 | 17 |
| BK005918 | 4677-6302 | gb:BK005918\| Organism:Porcine rubulavirus\| Strain Name:UNKNOWN-BK005918\| Protein Name:fusion protein\|Gene Symbol:F | MPQQQVAHTCVMLWGIISTVSGINTEA LSQYGVVVTNVRQLTYYTQAGSTYLA VRLLPSLASPDQSCALHSIINYNATLQAI LSPIAENLNLISTALREQHRKKRFAGVAI GLTALGVATAAQATAAVALVRANKNA EKVEQLSQALGETNAAISDLIDATKNLG FAVQAIQNQINTAILPQIHNLSCQVIDAQ LGNILSLYLTELTTVFQPQLTNPALSPLT IQALRAVLGTTLPALLSEKLKSNIPLGD LMSSGLLKGQLVGLNLQNMLMIIELYIP TLSTHSTAKVLDLVTISSHVNGREVEIQ VPNRVLELGSEVLGYGGSECALTMSHI LCPFNDARVLSTDMKYCLQGNITHCIFS | 7 | 18 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | PVVGSFLRRFALVNGVVIANCADMSCV CFDPQEIIYQNFQEPTTVIDIKKCGKVQL DTLTFTISTFANRTYGPPAYVPPDNIIQS EPLDISGNLIAVNNSLSSALNHLATSEIL RNEQIWTSSLGISTIVALVIIGILIICLVVT WAALWALLKEVRGLNSAVNSQLSSYV MGDKFIRY | | |
| KC237063 | 4530-6185 | gb:KC237063:4530-6185\|Organism:Parainfluenza virus 5\|Strain Name:08-1990\|Protein Name:fusion protein\|Gene Symbol:F\|Segment: 4 | MGTRIQFLMVSCLLAGTGSLDPAALMQ IGVIPTNVRQLMYYTEASSAFIVVKLMP TIDSPISGCNITSISSYNATMTKLLQPIGE NLETIRYQLIPTRRRRRFVGVVIGLAAL GVATAAQVTAAVALVKANKNAAAILN LKNAIQKTNAAVADVVQATQSLGTAV QAVQDHINSVVSPAITAANCKAQDAIIG SILNLYLTELTTIFHNQITNPALSPITIQA LRILLGSTLPTVVRKSFNTQISAAELLSS GLLTGQIVGLDLTYMQMVIKIELPTLTV QPATQIIDLVTISAFINNREVMAQLPTRII VTGSLIQAYPASQCTITPNTVYCRYNDA QVLSDDTMACLQGNLTRCTFSPVVGSF LTRFVLFDGIVYANCRSMLCKCMQPAA VILQPSSSPVTVIDMHKCVSLQLDNLRF TITQLANITYNSTIKLETSQILPIDPLDISQ NLAAVNKSLSDALQHLAQSDTYLSAIT SATTTSVLSIIAICLGSLGLILIILISVVVW KLLTIVAANRNRMENFVYHNSAFHHSR SDLSEKNQPATLGTR | 7 | 19 |
| AY729016 | 5862-7523 | gb:AY729016:5862-7523\|Organism:Murine pneumonia virus\|Strain Name:15; ATCC VR-25\|Protein Name:fusion glycoprotein precursor\|Gene Symbol:F | MIPGRIFLVLLVIFNTKPIHPNTLTEKFY ESTCSVETAGYKSALRTGWHMTVMSIK LSQINIESCKSSNSLLAHELAIYSSAVDE LRTLSSNALKSKRKKRFLGLILGLGAAV TAGVALAKTVQLESEIALIRDAVRNTNE AVVSLTNGMSVLAKVVDDLKNFISKEL LPKINRVSCDVHDITAVIRFQQLNKRLL EVSREFSSNAGLTHTVSSFMLTDRELTSI VGGMAVSAGQKEIMLSSKAIMRRNGL AILSSVNADTLVYVIQLPLFGVMDTDC WVIRSSIDCHNIADKYACLARADNGWY CHNAGSLSYFPSPTDCEIHNGYAFCDTL KSLTVPVTSRECNSNMYTTNYDCKISTS KTYVSTAVLTTMGCLVSCYGHNSCTVI NNDKGIIRTLPDGCHYISNKGVDRVQV GNTVYYLSKEVGKSIVVRGEPLVLKYD PLSFPDDKFDVAIRDVEHSINQTRTFLK ASDQLLDLSENRENKNLNKSYILTTLLF VVMLIIIMAVIGFILYKVLKMIRDNKLK SKSTPGLTVLS | 6 | 20 |
| AB543336 | 5174-6805 | gb:AB543336:5174-6805\|Organism:Human parainfluenza virus 4a\|Strain Name:M-25\|Protein Name:fusion protein\|Gene Symbol:F | MGVKGLSLIMIGLLISPITNLDITHLMNL GTVPTAIRSLVYYTYTKPSYLTVDLIPN LKNLDQNCNYSSLNYYNKTALSLIQPIA DNINRLTKPITSSEIQSRFFGAVIGTIALG VATAAQVTAAIGLAKAQENAKLILTLK KAATETNEAVRDLANSNKIVVKMISAI QNQINTIIQPAIDQINCQIKDLQVANILN LYLTEITTVFHNQLTNPALESISIQALKS LLGPTLPEVLSKLDLNNISAASVMASGL IKGQIIAVDIPTMTLVLMVQIPSISPLRQ AKIIDLTSITIHTNSQEVQAVVPARFLEI GSEILGFDGSVCQITKDTIFCPYNDAYEL PIQQKRCLQGQTRDCVFTPVAGTFPRRF LTTYGTIVANCRDLVCSCLRPPQIIYQPD ENPVTIIDKDLCTTLTLDSITIEIQKSINST FRREVVLESTQVRSLTPLDLSTDLNQYN QLLKSAEDHIQRSTDYLNSINPSIVNNN AIIILIILCILLILTVTICIIWLKYLTKEVKN VARNQRLNRDADLFYKIPSQIPVPR | 5 | 21 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| AF298895 | 4834-6450 | gb:AF298895\| Organism:Tioman virus\|Strain Name: UNKNOWN- AF298895\| Protein Name:fusion protein\|Gene Symbol:F | MRIALTAVIVSIHFDLAFPMNKNSLLSV GLVHKSVKNLYFYSQGSPSYIVVKLVP TLGNVPGNCTLNSLVRYKSTVSSLLSPL AENLEYLQKTLTVSRGGRRRRFAGVAI GLAALGVAAAAQATAAVALVEARQNA AQIQSLSEAIQNTNLAVNELKTAIGASA TAIQAIQTQINEVINPAINRLSCEILDAQL ASMLNLYLIHLTTVFQNQLTNPALTPLS IQSLQSLLQGTSSVLTNITSSSKLALNDA LVTGLITGQVVGLNMTSLQIVIAAYVPS VAKLSNAVVHNFIRITTSVNGTEVIIQSP TIIMEQNEVMYDLKTGHCTESDLNIYCP YVDAQLLSPGMTNCINGRLNDCTFSKV VGSFPTRFAAVEGAILANCKYLQCNCL TPPYIITPLNGEMISMIDLSKCQRLDLGT IVFDINNPVNVTFNGNYRADVGQMIVT NPLDISAELNQINTSLSNAQGFLSKSDA WLHVSQWVTNSGTIFIILIIGLIVGIVYMI INTYVVVQIIKEINRMRTSDRAHLLKGSI SSIST | 5 | 22 |
| FJ215863 | 4499-6130 | gb:FJ215863:4499- 61301\| Organism:Avian paramyxovirus 8\|Strain Name:goose/ Delaware/ 1053/76\| Protein Name:fusion protein\|Gene Symbol:F | MGQISVYLINSVLLLLVYPVNSIDNTLIA PIGVASANEWQLAAYTTSLSGTIAVRFL PVLPDNMTTCLRETITTYNNTVNNILGP LKSNLDALLSSETYPQTRLIGAVIGSIAL GVATSAQITAAVALKQAQDNARNILAL KEALSKTNEAVKELSSGLQQTAIALGKI QSFVNEEILPSINQLSCEVTANKLGVYL SLYLTELTTIFGAQLTNPALTSLSYQAL YNLCGGNMAMLTQKIGIKQQDVNSLY EAGLITGQVIGYDSQYQLLVIQVNYPSIS EVTGVRATELVTVSVTTDKGEGKAIVP QFVAESRVTIEELDVASCKFSSTTLYCR QVNTRALPPLVASCLRGNYDDCQYTTE IGALSSRYITLDGGVLVNCKSIVCRCLN PSKIISQNTNAAVTYVDATICKTIQLDDI QLQLEGSLSSVYARNISIEISQVTTSGSL DISSEIGNINNTVNRVEDLIHQSEEWLA KVNPHIVNNTTLIVLCVLSALAVIWLAV LTAIIIYLRTKLKTISALAVTNTIQSNPYV NQTKRESKF | 5 | 23 |
| JN689227 | 4689-6521 | gb:JN689227:4689- 6521\| Organism:Tailam virus\|Strain Name:TL8K\| Protein Name:fusion protein\|Gene Symbol:F | MKLSVVYTTLLVSTFYSDLARSQLALS ELTKIGVIPGRSYDLKISTQASYQYMVV KLIPNLTGLNNCTNGTIEAYKKMLNRL LSPIDAALRKMKDAVNDKPPESVGNVK FWGAVIGGVALGVATSAQITAGVALHN SIQNANAILALKDSIRQSNKAIQELQTA MSTTVVVLNALQDQINNQLVPAINSLG CQVVANTLGLKLNQYFSEISLVFGPNLR DPTSETLSIQALSRAFNGDFDSMLSKLK YDDSDFLDLLESDSIRGRIIDVSLSDYLI TIQIEYPALLSIKDAVIQTFNLISYNTRGT EWISIFPKQLLVRGTYISNIDISQCVIAAT SIICKSDTSTPISSATWSCATGNITNCAR TRVVNAHVPRFALYGGVVFANCAPVV CKCQDPLYSINQEPKVTNVMVDVDAC KEMYLDGLYITLGKTQISRAMYAEDVS LGGPISVDPIDLGNEINSINSAINRSEEHL NHANELLDKVNPRIVNVKTFGVMIGLL VLVVLWCVITLVWLICLTKQLARTAYA GSMGSRASTVNSLSGFVG | 5 | 24 |
| JX857409 | 4831-6615 | gb:JX857409:4831- 6615\| Organism:Porcine parainfluenza virus 1\|Strain | MQVTTLRPAIILSIALLVTGQVPRDKLA NLGIIIKDSKALKIAGSYENRYIVLSLVP TIDNVNGCGSIQIAKYKEMLERLLIPIKD ALDLQESLIVIDNETVNNNYSPQYRFVG AIIGTIALGVATAAQVTAGVALMEARE AKRDISMLKEAIEKTQNSIEKLQNSAGE | 5 | 25 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | Name:S206N\|Protein Name:fusion protein\|Gene Symbol:F | QILALKMLQDYVNGEIKPAIEELGCETA ALKLGIALTQHYTELTNAFGSNLGSIGE KSLTLQALSSLYKTNITNILTATNLGKT DIYDIIYAEQVKGRVIDVDLKRYMVTIS VKIPILSEIPGVLIYEVSSISYNIDGAEWY AAVPDHILSKSAYIGGADISDCIESRLTY ICPQDPAQIIADNQQCFFGHLDKCPITK VIDNLVPKFAFINGGVVANCIASTCTCG EERIQVSQDRNKGVTFLTHNNCGLIGIN GIEFHANKKGSDATWNVSPIGVGPAVS LRPVDISLQIVAATNFLNSSRKDLMKAK EILNQVGNLKDLTTITIINIVIIIILLICVIG LGILYHQLRSALGMRDKMSVLNNSSYS LEPRTAQVQVIKPTSFMG | | |
| AY640317 | 2932-4571 | gb:AY640317:2932-4571\|Organism:Avian metapneumovirus\|Strain Name:LAHA\|Protein Name:F\|Gene Symbol:F | MDVRICLLLFLISNPSSCIQETYNEESCS TVTRGYKSVLRTGWYTNVFNLEIGNVE NITCNDGPSLIDTELVLTKNALRELKTV SADQVAKESRLSSPRRRRFVLGAIALGV ATAAAVTAGVALAKTIRLEGEVKAIKN ALRNTNEAVSTLGNGVRVLATAVNDL KEFISKKLTPAINQNKCNIADIKMAISFG QNNRRFLNVVRQFSDSAGITSAVSLDL MTDDELVRAINRMPTSSGQISLMLNNR AMVRRKGFGILIGVYDGTVVYMVQLPI FGVIETPCWRVVAAPLCRKRRGNYACI LREDQGWYCTNAGSTAYYPNKDDCEV RDDYVFCDTAAGINVALEVDQCNYNIS TSKYPCKVSTGRHPVSMVALTPLGGLV SCYESVSCSIGSNKVGIIKQLGKGCTHIP NNEADTITIDNTVYQLSKVVGEQRTIKG APVVNNFNPILFPVDQFNVALDQVFESI DRSQDLIDKSNDLLGADAKSKAGIAIAI VVLVILGIFFLLAVIYYCSRVRKTKPKH DYPATTGHSSMAYVS | 4 | 26 |
| KU646513 | 4641-6498 | gb:KU646513:4641-6498\|Organism:Avian paramyxovirus 13 goose/Kazakhstan/5751/2013\|Strain Name:APMV-13/white fronted goose/Northern Kazakhstan/5751/2013\|Protein Name:fusion protein\|Gene Symbol:F | MARFSWEIFRLSTILLIAQTCQGSIDGRL TLAAGIVPVGDRPISIYTSSQTGIIVVKLI PNLPDNKKDCAKQSLQSYNETLSRILTP LATAMSAIRGNSTTQVRENRLVGAIIGS VALGVATAAQITAATALIQANQNAANI ARLANSIAKTNEAVTDLTEGLGTLAIGV GKLQDYVNEQFNNTAVAIDCLTLESRL GIQLSLYLTELMGVFGNQLTSPALTPITI QALYNLAGGNLNALLSRLGASETQLGS LINSGLIKGMPIMYDDANKLLAVQVEL PSIGKLNGARSTLLETLAVDTTRGPSSPI IPSAVIEIGGAMEELDLSPCITTDLDMFC TKIISYPLSQSTLSCLNGNLSDCVFSRSE GVLSTPYMTIKGKIVANCKQVICRCMD PPQILSQNYGEALLLIDENTCRSLELSGV ILKLAGTYESEYTRNLTVDPSQVIITGPL DISAELSKVNQSIDSAKENIAESNKFLSQ VNVKLLSSSAMITYIVATVVCLIIAITGC VIGIYTLTKLKSQQKTLLWLGNNAEMH GSRSKTSF | 4 | 27 |
| AF326114 | 4818-6482 | gb:AF326114\|Organism:Menangle virus\|Strain Name:UNKNOWN-AF326114\|Protein Name:fusion protein\|Gene Symbol:F | MMPRVLGMIVLYLTHSQILCINRNTLY QIGLIHRSVKKVNFYSQGSPSYIVVKLV PTLAAIPPNCSIKSLQRYKETVTSLVQPI SDNLGYLQDKLVTGQSRRRRRFAGVAI GLAALGVAAAAQATAAVALVETRENA GKIQALSESIQNTNQAVHSLKTALGFSA TAIQAIQNQVNEVINPAINKLSCEVLDS QLASMLNLYLIHLTTVFQTQLTNPALTP LSIQALTSVLQGTSGVLMNSTNSTLTQP IDLLATGLITGQIISVNMTSLQLIIATFMP SIAELPNAVLHSFFRITTSVNLTEVMIQS PEFIMEQNGVFYDFNTAHCQLGDNNVY | 3 | 28 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | CPYIDAARLSSMMTNCINGNLGECVFS RVIGSFPSRFVSLNGAILANCKFMRCNC LSPEKIITPLDGEMISLIDLRVCQKLTLG TITFEISQPVNVSFQGGFVANAGQIIVTN PFDISAELGQINNSLNDAQGFLDQSNN WLKVSGWINNSGSLFIAGIVVIGLIVLCI VIIIYINVQIIREVNRLRSFIYRDYVLDHD KAPYSPESSSPHRKSLKTVS | | |
| GU206351 | 5441-7468 | gb:GU206351:5441-7468\|Organism:Avian paramyxovirus 5\|Strain Name:budgerigar/Kunitachi/74\|Protein Name:fusion protein\|Gene Symbol:F | MLQLPLTILLSILSAHQSLCLDNSKLIHA GIMSTTEREVNVYAQSITGSIVVRLIPNI PSNHKSCATSQIKLYNDTLTRLLTPIKA NLEGLISAVSQDQSQNSGKRKKRFVGA VIGAAALGLATAAQVTATVALNQAQE NARNILRLKNSIQKTNEAVMELKDAVG QTAVAIDKTQAFINNQILPAISNLSCEVL GNKIGVQLSLYLTELTTVFGNQLTNPAL TTLSLQALYNLCGDDFNYLINLLNAKN RNLASLYEANLIQGRITQYDSMNQLLII QVQIPSISTVSGMRVTELFTLSVDTPIGE GKALVPKYVLSSGRIMEEVDLSSCAITS TSVFCSSIISRPLPLETINCLNGNVTQCQF TANTGTLESRYAVIGGLVIANCKAIVCR CLNPPGVIAQNLGLPITIISSNTCQRINLE QITLSLGNSILSTYSANLSQVEMNLAPS NPLDISVELNRVNTSLSKVESLIKESNSI LDSVNPQILNVKTVIILAVIIGLIVVWCFI LTCLIVRGFMLLVKQQKFKGLSVQNNP YVSNNSH | 3 | 29 |
| JQ001776 | 6129-8166 | gb:JQ001776:6129-8166\|Organism:Cedar virus\|Strain Name:CG1a\|Protein Name:fusion glycoprotein\|Gene Symbol:F | MSNKRTTVLIIISYTLFYLNNAAIVGFDF DKLNKIGVVQGRVLNYKIKGDPMTKD LVLKFIPNIVNITECVREPLSRYNETVRR LLLPIHNMLGLYLNNTNAKMTGLMIAG VIMGGIAIGIATAAQITAGFALYEAKKN TENIQKLTDSIMKTQDSIDKLTDSVGTSI LILNKLQTYINNQLVPNLELLSCRQNKI EFDLMLTKYLVDLMTVIGPNINNPVNK DMTIQSLSLLFDGNYDIMMSELGYTPQ DFLDLIESKSITGQIIYVDMENLYVVIRT YLPTLIEVPDAQIYEFNKITMSSNGGEY LSTIPNFILIRGNYMSNIDVATCYMTKA SVICNQDYSLPMSQNLRSCYQGETEYC PVEAVIASHSPRFALTNGVIFANCINTIC RCQDNGKTITQNINQFVSMIDNSTCND VMVDKFTIKVGKYMGRKDINNINIQIGP QIIIDKVDLSNEINKMNQSLKDSIFYLRE AKRILDSVNISLISPSVQLFLIIISVLSFIIL LIIIVYLYCKSKHSYKYNKFIDDPDYYN DYKRERINGKASKSNNIYYVGD | 3 | 30 |
| LC168749 | 4869-7235 | gb:LC168749:4869-7235\|Organism:Rinderpest morbillivirus\|Strain Name:Lv\|Protein Name:F protein\|Gene Symbol:F | MGILFAALLAMTNPHLATGQIHWGNLS KIGVVGTGSASYKVMTQSSHQSLVIKL MPNVTAIDNCTKTEIMEYKRLLGTVLK PIREALNAITKNIKPIQSSTTSRRHKRFA GVVLAGAALGVATAAQITAGIALHQSM MNSQAIESLKASLETTNQAIEEIRQAGQ EMVLAVQGVQDYINNELVPAMGQLSC EIVGQKLGLKLLRYYTEILSLFGPSLRDP VSAELSIQALSYALGGDINKILEKLGYS GSDLLAILESKGIKAKITYVDIESYFIVLS IAYPSLSEIKGVIVHRLESVSYNIGSQEW YTTVPRYVATQGYLISNFDDTPCAFTPE GTICSQNALYPMSPLLQECFRGSTRSCA RTLVSGSIGNRFILSKGNLIANCASILCK CYTTGSIISQDPDKILTYIAADQCPVVEV GGVTIQVGSREYSDAVYLHEIDLGPPIS LEKLDVGTNLWNAVTKLEKAKLLDS SDLILENIKGVSVTNTGYILVGVGLIAV | 2 | 31 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | VGILIITCCCKKRRSDNKVSTMVLNPGL RPDLTGTSKSYVRSL | | |
| LC187310 | 6250-7860 | gb:LC187310:6250-7860\| Organism:Avian paramyxovirus 10\|Strain Name:rAPMV-10-FI324/YmHA\| Protein Name:fusion protein\|Gene Symbol:F | MTRTRLLFLLTCYIPGAVSLDNSILAPA GIISASERQIAIYTQTLQGTIALRFIPVLP QNLSSCAKDTLESYNSTVSNLLLPIAEN LNALLKDADKPSQRIIGAIIGSVALGVA TTAQVTAALAMTQAQQNARNIWKLKE SIKNTNQAVLELKDGLQQSAIALDKVQ SFINSEILPQINQLGCEVAANKLGIFLSL YLTEITTVFKNQITNPALSTLSYQALYN LCGGNMAALTKQIGIKDTEINSLYEAEL ITGQVIGYDSADQILLIQVSYPSVSRVQG VRAVELLTVSVATPKGEGKAIAPSFIAQ SNIIAEELDTQPCKFSKTTLYCRQVNTR TLPVRVANCLKGKYNDCQYTTEIGALA SRYVTITNGVVANCRSIICRCLDPEGIVA QNSDAAITVIDRSTCKLIQLGDITLRLEG KLSSSYSKNITIDISQVTTSGSLDISSELG SINNTITKVEDLISKSNDWLSKVNPTLIS NDTIIALCVIAGIVVIWLVIITILSYYILIK LKNVALLSTMPKKDLNPYVNNTKF | 2 | 32 |
| NC_005283 | 5277-6935 | gb:NC_005283:5277-6935\| Organism:Dolphin morbillivirus\|Strain Name:UNKNOWN-NC_00528 3\|Protein Name:fusion protein\|Gene Symbol:F | MAASNGGVMYQSFLTIIILVIMTEGQIH WGNLSKIGIVGTGSASYKVMTRPNHQY LVIKLMPNVTMIDNCTRTEVTEYRKLL KTVLEPVKNALTVITKNIKPIQSLTTSRR SKRFAGVVLAGVALGVATAAQITAGV ALHQSIMNSQSIDNLRTSLEKSNQAIEEI RQASQETVLAVQGVQDFINNELIPSMH QLSCEMLGQKLGLKLLRYYTEILSIFGP SLRDPVSAEISIQALSYALGGDINKILEK LGYSGADLLAILESRGIKAKVTHVDLEG YFIVLSIAYPTLSEVKGVIVHKLEAVSY NLGSQEWYTTLPKYVATNGYLISNFDE SSCAFMSEVTICSQNALYPMSPLLQQCL RGSTASCARSLVSGTIGNRFILSKGNLIA NCASVLCKCYSTGTIISQDPDKLLTFVA ADKCPLVEVDGITIQVGSREYPDSVYVS RIDLGPAISLEKLDVGTNLGSALTKLDN AKDLLDSSNQILENVRRSSFGGAMYIGI LVCAGALVILCVLVYCCRRHCRKRVQT PPKATPGLKPDLTGTTKSYVRSL | 2 | 33 |
| NC_005339 | 5374-7602 | gb:NC_005339:5374-7602\| Organism:Mossman virus\|Strain Name:UNKNOWN-NC_005339\| Protein Name:fusion protein\|Gene Symbol:F | MSNYFPARVIIIVSLITAVSCQISFQNLST IGVFKFKEYDYRVSGDYNEQFLAIKMV PNVTGVENCTASLIDEYRHVIYNLLQPI NTTLTASTSNVDPYAGNKKFFGAVIAG VALGVATAAQVTAGVALYEARQNAAA IAEIKESLHYTHKAIESLQISQKQTVVAI QGIQDQINTNIIPQINALTCEIANQRLRL MLLQYYTEMLSSFGPIIQDPLSGHITVQ ALSQAAGGNITGLMRELGYSSKDLRYI LSVNGISANIIDADPEIGSIILRIRYPSMIK IPDVAVMELSYLAYHAAGGDWLTVGP RFILKRGYSLSNLDITSCTIGEDFLLCSK DVSSPMSLATQSCLRGDTQMCSRTAVQ DREAPRFLLLQGNLIVNCMSVNCKCED PEETITQDPAYPLMVLGSDTCKIHYIDGI RIKLGKVQLPPITVLNTLSLGPIVVLNPI DVSNQLSLVETTVKESEDHLKNAIGAL RSQSRVGGVGIVAIVGLIIATVSLVVLVI SGCCLVKYFSRTATLESSLTTIEHGPTLA PKSGPIIPTYINPVYRHD | 2 | 34 |
| NC_007454 | 4635-6384 | gb:NC_007454:4635-6384\| Organism:J-virus\|Strain | MKPVALIYLTILAFTVKVRSQLALSDLT KIGIIPAKSYELKISTQAAQQLMVIKLIP NVNGLTNCTIPVMDSYKKMLDRILKPI DDALNHVKNAIQDKQGDGVPGVRFWG | 2 | 35 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | Name:UNKNOWN-NC_007454\|Protein Name:fusion protein\|Gene Symbol:F | AIIGGVALGVATSAQITAGVALHNSIQNANAILQLKESIRNSNKAIEELQAGLQSTVLVINALQDQINSQLVPAINTLGCSVIANTLGLRLNQYFSEISLVFGPNLRDPTSQTLSIQAIAKAFNGDFDSMMKKMHYTDSDFLDLLESDSIRGRIISVSLEDYLIIIQIDYPGLTTIPNSVVQTFNLITYNYKGTEWESIFPRELLIRGSYISNIDISQCVGTSKSMICKSDTSTTISPATWACATGNLTSCARTRVVNSHSTRFALSGGVLFANCAPIACRCQDPQYSINQEPKTTNVMVTSEDCKELYIDGFYLTLGKKMLDRAMYAEDVALGGSVSVDPIDIGNELNSINESINKSHEYLDKANELLEQVNPNIVNVSSFSFILVISILLIIWFIVTLVWLIYLTKHMNFIVGKVAMGSRSSTVNSLSGFVG | | |
| NC_009489 | 4620-6500 | gb:NC_009489:4620-6500\|Organism:Mapuera virus\|Strain Name:BeAnn 370284\|Protein Name:fusion protein\|Gene Symbol:F | MRSSLFLVLTLLVPFAHSIDSITLEQYGTVITSVRSLAYFLETNPTYISVRLMPAIQTDSSHCSYHSIENYNLTLTKLLLPLQENLHQITDSLSSRRRKKRFAGVAVGLAALGVATAAQVTAAIAVVKAKENSAKIAQLTSAISETNRAVQDLIEGSKQLAVAVQAIQDQINNVIQPQLTNLSCQVADAQVGTILNMYLTELTTVFHPQITNSALTPITIQALRSLLGSTLPQVVTSTIKTDVPLQDLLTSGLLKGQIVYLDLQSMIMVVSVSVPTIALHSMAKVYTLKAISAHVNNAEVQMQVPSRVMELGSEIMGYDIDQCEETSRYLFCPYNGGSILSATMKMCLNGNISQCVFTPIYGSFLQRFVLVDGVIVANCRDMTCACKSPSKIITQPDSLPVTIIDSTSCSNLVLDTLELPIISINNATYRPVQYVGPNQIIFSQPLDLLSQLGKINSSLSDAIEHLAKSDEILEQIQWDSPQGYTLIALTSVLAFVVVAIVGLLISTRYLIFEIRRINTTLTQQLSSYVLSNKIIQY | 2 | 36 |
| NC_017937 | 4534-6330 | gb:NC_017937:4534-6330\|Organism:Nariva virus\|Strain Name:UNKNOWN-NC_017937\|Protein Name:fusion protein\|Gene Symbol:F | MAEQEKTPLRYKILLIIIVINHYNITNVFGQIHLANLSSIGVFVTKTLDYRTTSDPTEQLLVINMLPNISNIQDCAQGVVNEYKHLISSLLTPINDTLDLITSNINPYSGRNKLFGEIIAGAALTVATSAQITAGVALYEARQNAKDIAAIKESLGYAYKAIDKLTTATREITVVINELQDQINNRLIPRINDLACEVWATRLQAMLLQYYAEIFSVIGPNLQDPLSGKISIQALARAAGGNIKLMVDELNYSGQDLSRLVKVGAIKGQIIDADPSLGVVIIKMRYPNIIKIPNVAISELSYVSYSSDGQDWITTGPNYIVTRGYSIANIQTSSCSVGDDFVLCDRDMTYPMSQVTQDCLRGNIALCSRMVVRDREAPRYLILQGNMVANCMSITCRCEEPESEIYQSPDQPLTLLTRDTCDTHVVDGIRIRLGVRKLPTISVINNITLGPIITTDPIDVSNQLNAVVSTIDQSAELLHQAQRVLSERARGARDHILATAAIVICVVLAVLILVLLIGLVYLYRTQNEILVKTTMLEQVPTFAPKSFPMESQIYSGKTNKGYDPAE | 2 | 37 |
| NC_025256 | 6865-8853 | gb:NC_025256:6865-8853\|Organism:Bat Paramyxovirus Eid_hel/GH-M74a/GHA/2009\|Strain Name:Bat PV/Eid_hel/GH-M74a/GHA/2009\| | MKKKTDNPTISKRGHNHSRGIKSRALLRETDNYSNGLIVENLVRNCHHPSKNNLNYTKTQKRDSTIPYRVEERKGHYPKIKHLIDKSYKHIKRGKRRNGHNGNIITIILLLILILKTQMSEGAIHYETLSKIGLIKGITREYKVKGTPSSKDIVIKLIPNVTGLNKCTNISMENYKEQLDKILIPINNIIELYANSTKSAPGNARFAGVIIAGVALGVAAAAQITAGIALHEARQNAERINLLKDSISATNNAVAELQEATGGIVNVITGMQDYINTNL | 2 | 38 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | Protein Name:fusion protein\|Gene Symbol:F | VPQIDKLQCSQIKTALDISLSQYYSEILT VFGPNLQNPVTTSMSIQAISQSFGGNIDL LLNLLGYTANDLLDLLESKSITGQITYIN LEHYFMVIRVYYPIMTTISNAYVQELIKI SFNVDGSEWVSLVPSYILIRNSYLSNIDI SECLITKNSVICRHDFAMPMSYTLKECL TGDTEKCPREAVVTSYVPRFAISGGVIY ANCLSTTCQCYQTGKVIAQDGSQTLM MIDNQTCSIVRIEEILISTGKYLGSQEYN TMHVSVGNPVFTDKLDITSQISNINQSIE QSKFYLDKSKAILDKINLNLIGSVPISILF IIAILSLILSIITFVIVMIIVRRYNKYTPLIN SDPSSRRSTIQDVYIIPNPGEHSIRSAARS IDRDRD | | |
| NC_025347 | 4471-6386 | gb:NC_025347:4471-6386\|Organism:Avian paramyxovirus 7\|Strain Name:APMV-7/dove/Tennessee/4/75\|Protein Name:fusion protein\|Gene Symbol:F | MRVRPLIIILVLLVLLWLNILPVIGLDNS KIAQAGIISAQEYAVNVYSQSNEAYIAL RTVPYIPPHNLSCFQDLINTYNTTIQNIFS PIQDQITSITSASTLPSSRFAGLVVGAIAL GVATSAQITAAVALTKAQQNAQEIIRLR DSIQNTINAVNDITVGLSSIGVALSKVQ NYLNDVINPALQNLSCQVSALNLGIQL NLYLTEITTIFGPQITNPSLTPLSIQALYT LAGDNLMQFLTRYGYGETSVSSILESGL ISAQIVSFDKQTGIAILYVTLPSIATLSGS RVTKLMSVSVQTGVGEGSAIVPSYVIQ QGTVIEEFIPDSCIFTRSDVYCTQLYSKL LPDSILQCLQGSMADCQFTRSLGSFANR FMTVAGGVIANCQTVLCRCYNPVMIIP QNNGIAVTLIDGSLCKELELEGIRLTMA DPVFASYSRDLIINGNQFAPSDALDISSE LGQLNNSISSATDNLQKAQESLNKSIIPA ATSSWLIILLFVLVSISLVIGCISIYFIYKH STTNRSRNLSSDIISNPYIQKAN | 2 | 39 |
| NC_025348 | 4790-6570 | gb:NC_025348:4790-6570\|Organism:Tuhoko virus 2\|Strain Name:UNKNOWN-NC_025348\|Protein Name:fusion protein\|Gene Symbol:F | MAPCVLFLSSLLLISTISPSHGINQPALR RIGAIVSSVKQLKFYSKTKPNYIIVKLLP TINLSKSNCNLTSINRYKESVIEIIKPLAD NIDNLNQKLLPKNRRKRMAGVAIGLAA LGVAAAAQATAAVALVEARKNTQMIQ SLADSIQDTNAAVQAVNIGLQNSAVAI QAIQNQINNVINPALDRLNCEVLDAQIA SILNLYLIKSVTIFQNQLTNPALQQLSIQ MLSIVMQDTAKILGNFTIGDKFDQHDL LGSGLITGQVVGVNLTNLQLIIAAFIPSI APLPQAYIIDLISITISVNDTEAVIQIPERI MEHGSSIYQFGGKQCVYGQFSAYCPFS DAVLMTQDLQLCMKGNIEHCIFSSVLG SFPNRFASVDGVFYANCKYMSCACSDP LQVIHQDDSVNLMVIDSSVCRSLTLGH VTFPIIAFSNVSYQMKTNISIEQMIVTSPL DLSTELKQINNSVNIANTFLDSSNRALK TSIFGTSSQIILIVLLIFTCLLILYVIFLTYII KILIKEVKRLRDGNSRTGSKLSFINPDV | 2 | 40 |
| NC_025350 | 4663-6428 | gb:NC_025350:4663-6428\|Organism:Tuhoko virus 3\|Strain Name:UNKNOWN-NC_025358\|Protein Name:fusion protein\|Gene Symbol:F | MLWLTILIALVGNHESTCMNINFLQSLG QINSQKRFLNFYTQQPPSYMVIRLVPTL QLSANNCTLGSIVRYRNAIKELIQPMDE NLRWLSSNLIPQRRGKRFAGVAVGLAA LGVAVAAQATAAVALVEARANAEKIA SMSQSIQETNKAVTSLSQAVSASGIAIQ AIQNEINNVIHPILNQVQCDVLDARVGN ILNLYLIKVTTIFQNQLTNPALQRLSTQA LSMLMQSTSSYLRNLSSSESAINADLSM TNLIEAQIVGINMTNLQLVLAVFIPSIAR LNGALLYDFISITISSNQTEVMLQIPHRV LEIGNSLYTFEGTQCEMTKLNAYCLYS DAIPVTESLRDCMNGLFSQCGFVRIIGSF ANRFASVNGVIYANCKHLTCSCLQPDEI | 2 | 41 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | ITQDTNVPLTIIDTKRCTKISLGHLTFTIR EYANVTYSLRTEIANSQITVVSPLDLSS QLTTINNSLADATNHIMNSDRILDRLNS GLYSKWVIIFLICASIVSLIGLVFLGFLIR GLILELRSKHRSNLNKASTYSIDSSIGLT | | |
| NC_025352 | 5950-8712 | gb:NC_025352:5950-8712\|Organism:Mojiang virus\|Strain Name:Tongguan1\|Protein Name:fusion protein\|Gene Symbol:F | MALNKNMFSSLFLGYLLVYATTVQSSI HYDSLSKVGVIKGLTYNYKIKGSPSTKL MVVKLIPNIDSVKNCTQKQYDEYKNLV RKALEPVKMAIDTMLNNVKSGNNKYR FAGAIMAGVALGVATAATVTAGIALHR SNENAQAIANMKSAIQNTNEAVKQLQL ANKQTLAVIDTIRGEINNNIIPVINQLSC DTIGLSVGIRLTQYYSEIITAFGPALQNP VNTRITIQAISSVFNGNFDELLKIMGYTS GDLYEILHSELIRGNIIDVDVDAGYIALE IEFPNLTLVPNAVVQELMPISYNIDGDE WVTLVPRFVLTRTTLLSNIDTSRCTITDS SVICDNDYALPMSHELIGCLQGDTSKC AREKVVSSYVPKFALSDGLVYANCLNT ICRCMDTDTPISQSLGATVSLLDNKRCS VYQVGDVLISVGSYLGDGEYNADNVE LGPPIVIDKIDIGNQLAGINQTLQEAEDY IEKSEEFLKGVNPSIITLGSMVVLYIFMIL IAIVSVIALVLSIKLTVKGNVVRQQFTYT QHVPSMENINYVSH | 2 | 42 |
| NC_025363 | 4622-6262 | gb:NC_025363:4622-6262\|Organism:Avian paramyxovirus 12\|Strain Name:Wigeon/Italy/3920_1/2005\|Protein Name:fusion protein\|Gene Symbol:F | MAIPVPSSTALMIFNILVSLAPASALDGR LLLGAGIVPTGDRQVNVYTSSQTGIIAL KLLPNLPKDKENCAEVSIRSYNETLTRI LTPLAQSMAAIRGNSTVSTRGREPRLVG AIIGGVALGVATAAQITAATALIQANQN AENIARLAKGLAATNEAVTDLTKGVGS LAIGVGKLQDYVNEQFNRTGEAIECLTI ESRVGVQLSLYLTEVIGVFGDQITSPAL SDISIQALYNLAGGNLNVLLQKMGIEGT QLGSLINSGLIKGRPIMYDDGNKILGIQV TLPSVGRINGARATLLEAIAVATPKGNA SPLIPRAVISVGSLVEELDMTPCVLTPTD IFCTRILSYPLSDSLTTCLKGNLSSCVFS RTEGALSTPYVSVHGKIVANCKSVVCR CVEPQQIISQNYGEALSLIDESLCRILEL NGVILKMDGQFTSEYTKNITIDPVQVIIS GPIDISSELSQVNQSLDSALENIKESNSY LSKVNVKLISSSAMITYIVITVICLILTFV ALVLGIYSYTKIRSQQKTLIWMGNNIAR SKEGNRF | 2 | 43 |
| NC_025373 | 4617-6582 | gb:NC_025373:4617-6582\|Organism:Avian paramyxovirus 3\|Strain Name:turkey/Wisconsin/68\|Protein Name:fusion protein\|Gene Symbol:F | MASPMVPLLIITVVPALISSQSANIDKLI QAGIIMGSGKELHIYQESGSLDLYLRLL PVIPSNLSHCQSEVITQYNSTVTRLLSPI AKNLNHLLQPRPSGRLFGAVIGSIALGV ATSAQISAAIALVRAQQNANDILALKA AIQSSNEAIKQLTYGQEKQLLAISKIQK AVNEQVIPALTALDCAVLGNKLAAQLN LYLIEMTTIFGDQINNPVLTPIPLSYLLRL TGSELNDVLLQQTRSSLSLIHLVSKGLL SGQIIGYDPSVQGIIIRIGLIRTQRIDRSLV FXPYVLPITISSNIATPIIPDCVVKKGVIIE GMLKSNCIELERDIICKTINTYQITKETR ACLQGNITMCKYQQSRTQLSTPFITYNG VVIANCDLVSCRCIRPPMIITQVKGYPLT IINRNLCTELSVDNLILNIETNHNFSLNP TIIDSQSRLIATSPLEIDALIQDAQHHAA AALLKVEESNAHLLRVTGLGSSSWHIIL ILTLLVCTIAWLIGLSIYVCRIKNDDSTD KEPTTQSSNRGIGVGSIQYMT | 2 | 44 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| NC_025386 | 5548-7206 | gb:NC_025386:5548-7206\|Organism:Salem virus\|Strain Name:UNKNOWN-NC_025386\|Protein Name:fusion protein\|Gene Symbol:F | MNPLNQTLIAKVLGFLLLSSSFTVGQIGPENLTRIGVHQVKQYGYKLAHYNSHQLLLIRMIPTVNGTHNCTHQVITRYREMVREIITPIKGALDIMKKAVSPDLVGARIFGAIVAGAALGIATSAQITAGVALHRTKLNGQEISKLKEAVSLTNEAVEQLQYSQGKSILAIQGIQDFINFNVVPLLEEHTCGIAKLHLEMALMEYFQKLILVFGPNLRDPIGSTIGIQALATLFQNNMFEVSLRLGYAGDDLEDVLQSNSIRANIIEAEPDSGFIVLAIRYPTLTLVEDQVITELAHITFNDGPQEWVATIPQFVTYRGLVLANIDVSTCTFTERNVICARDQTYPMIIDLQLCMRGNIAKCGRTRVTGSTASRFLLKDGNMYANCIATMCRCMSSSSIINQEPSHLTTLIVKETCSEVMIDTIRITLGERKHPPIDYQTTITLGQPIALAPLDVGTELANAVSYLNKSKVLLEHSNEVLSSVSTAHTSLTATIVLGIVVGGLAILIVVMFLFLEAQVIKVQRAMMLCPITNHGYLPNEDLLTRGHSIPTIG | 2 | 45 |
| NC_025390 | 4805-6460 | gb:NC_025390:4805-6460\|Organism:Avian paramyxovirus 9\|Strain Name:duck/New York/22/1978\|Protein Name:fusion protein\|Gene Symbol:F | MGYFHLLLILTAIAISAHLCYTTTLDGRKLLGAGIVITEEKQVRVYTAAQSGTIVLRSFRVVSLDRYSCMESTIESYNKTVYNILAPLGDAIRRIQASGVSVERIREGRIFGAILGGVALGVATAAQITAAIALIQANENAKNILRIKDSITKTNEAVRDVTNGVSQLTIAVGKLQDFVNKEFNKTTEAINCVQAAQQLGVELSLYLTEITTVFGPQITSPALSKLTIQALYNLAGVSLDVLLGRLGADNSQLSSLVSSGLITGQPILYDSESQILALQVSLPSISDLRGVRATYLDTLAVNTAAGLASAMIPKVVIQSNNIVEELDTTACIAAEADLYCTRITTFPIASAVSACILGDVSQCLYSKTNGVLTTPYVAVKGKIVANCKHVTCRCVDPTSIISQNYGEAATLIDDQLCKVINLDGVSIQLSGTFESTYVRNVSISANKVIVSSSIDISNELENVNSSLSSALEKLDESDAALSKVNVHLTSTSAMATYIVLTVIALILGFVGLGLGCFAMIKVKSQAKTLLWLGAHADRSYILQSKPAQSST | 2 | 46 |
| NC_025403 | 4826-6649 | gb:NC_025403:4826-6649\|Organism:Achimota virus 1\|Strain Name:UNKNOWN-NC_025403\|Protein Name:fusion protein\|Gene Symbol:F | MWIMIILSLFQIIPGVTPINSKVLTQLGVITKHTRQLKFYSHSTPSYLVVKLVPTINTESTVCNFTSLSRYKDSVRELITPLAKNIDNLNSILTIPKRRKRMAGVVIGLAALGVAAAAQATAAVALIEAKKNTEQIQALSESIQNTNKAVSSIEKGLSSAAIAVQAIQNQINNVINPALTALDCGVTDAQLGNILNLYLIKTLTVFQKQITNPALQPLSIQALNIIMQETSSVLRNFTKTDEIEHTDLLTSGLITGQVVGVNLTNLQLIIAAFIPSIAPLNQAYILDFIRITVNINNSESMIQIPERIMEHGISLYQFGGDQCTFSDWSAYCPYSDATLMAPGLQNCFRGQAADCVFSTVMGSFPNRFVSVQGVFYVNCKFIRCACTQPQRLITQDDSLSLTQIDAKTCRMLTLGFVQFSINEYANVTYSFKNNVTAGQLIMTNPIDLSTEIKQMNDSVDEAARYIEKSNAALNKLMYGGRSDIVTTVLLVGFILLVVYVIFVTYILKILMKEVARLRNSNHPDLIKPYNYPM | 2 | 47 |
| NC_025404 | 4772-6647 | gb:NC_025404:4772-6647\|Organism:Achimota virus 2\|Strain Name:UNKNOWN- | MLNSFYQIICLAVCLTTYTVISIDQHNLLKAGVIVKSIKGLNFYSRGQANYIIVKLIPNVNVTDTDCDIGSIKRYNETVYSLIKPLADNIDYLRTQFAPTKRKKRFAGVAIGLTALGVATAAQVTAAVALVKAQENARKLDALADSIQATNEAVQDLSTGLQAGAI | 2 | 48 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | NC_025404\|Protein Name:fusion protein\|Gene Symbol:F | AIQAIQSEINHVINPALERLSCEIIDTRVASILNLYLIRLTTVFHRQLVNPALTPLSIQALNHLLQGETEGLVKNESKMTDSKIDLLMSGLITGQVVGVNIKHMQLMIAVFVPTTAQLPNAYVINLLTITANINNSEVLVQLPNQILERSGIIYQFRGKDCVSSPNHMYCPYSDASILSPELQLCLQGRLEMCLFTQVVGSFPTRFASDKGIVYANCRHLQCACSEPEGIIYQDDTSAITQIDASKCSTLKLDMLTFKLSTYANKTFDASFSVGKDQMLVTNLLDLSAELKTMNASVAHANKLIDKSNLLIQSNALIGHSNTIFIVVIVILAVMVLYLIIVTYIIKVIMVEVSRLKRMNIYSIDK | | |
| NC_025410 | 4958-6751 | gb:NC_025410:4958-6751\|Organism:Tuhoko virus 1\|Strain Name:UNKNOWN-NC_025410\|Protein Name:fusion protein\|Gene Symbol:F | MVTIIKPLILLVTVILQISGHIDTTALTSIGAVIASSKEIMYYAQSTPNYIVIKLIPNLPNIPSQCNFSSIAYYNKTLLDLFTPISDNINMLHQRLSNTGRNRRFAGVAIGLAALGVATAAQVTAAFALVEAKSNTAKIAQIGQAIQNTNAAINSLNAGIGGAVTAIQAIQTQINGIITDQINAATCTALDAQIGTLLNMYLLQLTTTFQPQIQNPALQPLSIQALHRIMQGTSIVLSNLTDSSKYGLNDALSAGLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVIIANCKFIRCTCLQPEGIISQLDDHTLTVIDLKLCNKLDLGLIQFDLQVLSNISYEMTLNTSQNQLILTDPLDLSSELQTMNQSINNAANFIEKSNSLLNSSTYEFNRSVALLVALILLSLTILYVIVLTCVVKLLVHEVSKNRRHIQDLESHHK | 2 | 49 |
| NC_028249 | 4850-7055 | gb:NC_028249:4850-7055\|Organism:Phocine distemper virus\|Strain Name:PDV/Wadden_Sea.NLD/1988\|Protein Name:fusion protein\|Gene Symbol:F | MTRVKKLPVPTNPPMHHSLDSPFLNPEHATGKISITDDTSSQLTNFLYHKYHKTTINHLSRTISGTDPPSAKLNKFGSPILSTYQIRSALWWIAMVILVHCVMGQIHWTNLSTIGIIGTDSSHYKIMTRSSHQYLVLKLMPNVSIIDNCTKAELDEYEKLLNSVLEPINQALTLMTKNVKSLQSLGSGRRQRRFAGVVIAGAALGVATAAQITAGVALYQSNLNAQAIQSLRASLEQSNKAIDEVRQASQNIIIAVQGVQDYVNNEIVPALQHMSCELIGQRLGLKLLRYYTELLSVFGPSLRDPVSAEISIQALSYALGGEIHKILEKLGYSGNDMVAILETKGIRAKITHVDLSGKFIVLSISYPTLSEVKGVVVHRLEAVSYNIGSQEWYTTVPRYVATNGYLISNFDESSCVFVSESAICSQNSLYPMSPILQQCLRGETASCARTLVSGTLGNKFILSKGNIIANCASILCKCHSTSKIINQSPDKLLTFIASDTCSLVEIDGVTIQVGSRQYPDVVYASKVILGPAISLERLDVGTNLGSALKKLNDAKVLIESSDQILDTVKNSYLSLGTLIALPVSIGLGLILLLLICCCKKRYQHLFSQSTKVAPVFKPDLTGTSKSYVRSL | 2 | 50 |
| NC_028362 | 5217-6842 | gb:NC_028362:5217-6842\|Organism:Caprine parainfluenza virus 3\|Strain Name:JS2013\|Protein Name:fusion protein\|Gene Symbol:F | MIKKIICIFSMPILLSFCQVDIIKLQRVGILVSKPKSIKISQNFETRYLVLNLIPNIENAQSCGDQQIKQYKKLLDRLIIPLYDGLRLQQDIIVVDNNLKNNTNHRAKRFFGEIIGTIALGVATSAQITAAVALVEAKQARSDIERVKNAVRDTNKAVQSIQGSVGNLIVAVKSVQDYVNNEIVPSIKRLGCEAAGLQLGIALTQHYSELTNIFGDNIGTLKEKGIKLQGIASLYHTNITEIFTTSTVDQYDIYDLLFTESIKMRVIDVDLNDYSITLQVRLPLLTKISDAQIYNVDSVSYNIGGTEWYIPLP | 2 | 51 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | RNIMTKGAFLGGANLQDCIESFSDYICP SDPGFILNRDIENCLSGNITQCPKTLVIS DIVPRYAFVDGGVIANCLSTTCTCNGID NRINQAPDQGIKIITYKDCQTIGINGMLF KTNQEGTLAAYTPVDITLNNSVNLDPID LSIELNRARSDLAESKEWIKRSEAKLDS VGSWYQSSTTEIIQIVMIIVLFIINIIVLIV LIKYSRSQNQSMNNHMNEPYILTNKVQ | | |
| AF079780 | 5919-7580 | gb:AF079780\| Organism:Tupaia paramyxovirus\|Strain Name:UNKNOWN-AF0797801 Protein Name:fusion protein\|Gene Symbol:F | MASLLKTICYIYLITYAKLEPTPKSQLDL DSLASIGVVDAGKYNYKLMTTGSEKL MVIKLVPNITYATNCNLTAHTAYTKMI ERLLTPINQSLYEMRSVITERDGGTIFW GAIIAGAALGVATAAAITAGVALHRAE QNARNIAALKDALRNSNEAIQHLKDAQ GHTVLAIQGLQEQINNNIIPKLKESHCL GVNNQLGLLLNQYYSEILTVFGPNLQN PVSASLTIQAIAKAFNGDFNSLMTNLNY DPTDLLDILESNSINGRIIDVNLNEKYIA LSIEIPNFITLTDAKIQTFNRITYGYGSNE WLTLIPDNILEYGNLISNVDLTSCVKTK SSYICNQDTSYPISSELTRCLRGDTSSCP RTPVVNSRAPTFALSGGHIYANCAKAA CRCEKPPMAIVQPATSTLTFLTEKECQE VVIDQINIQLAPNRLNKTIITDGIDLGPE VIINPIDVSAELGNIELEMDKTQKALDR SNKILDSMITEVTPDKLLIAMIVVFGILL LWLFGVSYYAFKIWSKLHFLDSYVYSL RNPSHHRSNGHQNHSFSTDISG | 1 | 52 |
| EU403085 | 4664-6585 | gb:EU403085:4664-6585\| Organism:Avian paramyxovirus 3\|Strain Name:AP MV3/PKT/ Netherland/ 449/75\| Protein Name:fusion protein\|Gene Symbol:F | MQPGSALHLPHLYIIIALVSDGTLGQTA KIDRLIQAGIVLGSGKELHISQDSGTLDL FVRLLPVLPSNLSHCQLEAITQYNKTVT RLLAPIGKNLEQVLQARPRGRLFGPIIGS IALGVATSAQITAAIALVRAQQNANDIL ALKNALQSSNEAIRQLTYGQDKQLLAIS KIQKAVNEQILPALDQLDCAVLGTKLA VQLNLYLIEMTTIFGEQINNPVLATIPLS YILRLTGAELNNVLMKQARSSLSLVQL VSKGLLSGQVIGYDPSVQGLIIRVNLMR TQKIDRALVYQPYVLPITLNSNIVTPIAP ECVIQKGTIIEGMSRKDCTELEQDIICRT VTTYTLARDTRLCLQGNISSCRYQQSGT QLHTPFITYNGAVIANCDLVSCRCLRPP MIITQVKGYPLTIITRSVCQELSVDNLVL NIETHHNFSLNPTIIDPLTRVIATTPLEID SLIQEAQDHANAALAKVEESDKYLRAV TGGNYSNWYIVLVIVLLFGNLGWSLLL TVLLCRSRKQQRRYQQDDSVGSERGV GVGTIQYMS | 1 | 53 |
| KX258200 | 4443-6068 | gb:KX258200:4443-6068\| Organism:Avian paramyxovirus 14\|Strain Name:AP MV14/duck/ Japan/ 11OG0352/ 2011\|Protein Name:fusion protein\|Gene Symbol:F | MEKGTVLFLAALTLYNVKALDNTKLL GAGIASGKEHELKIYQSSVNGYIAVKLI PFLPSTKRECYNEQLKNYNATINRLMG PINDNIKLVLSGVKTRTREGKLIGAIIGT AALGLATAAQVTAAIALEQAQDNARAI LTLKESIRNTNNAVSELKTGLSEVSIALS KTQDYINTQIMPALSNLSCEIVGLKIGIQ LSQYLTEVTAVFGNQITNPALQPLSMQ ALYQLCGGDFSLLLDKIGADRNELESL YEANLVTGRIVQYDTADQLVIIQVSIPS VSTLSGYRVTELQSISVDMDHGEGKAV IPRYIVTSGRVIEEMDISPCVLTATAVYC NRLLTTSLPESVLKCLDGDHSSCTYTSN SGVLETRYIAFDGMLIANCRSIVCKCLD PPYIIPQNKGKPLTIISKEVCKKVTLDGIT LLIDAEFTGEYGLNITIGPDQFAPSGALD ISTELGKLNNSINKAEDYIDKSNELLNR VNVDIVNDTAVIVLCVMSALVVVWCIG | 1 | 54 |

TABLE 1-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | LTVGLIYVSKNTLRAVAIKGTSIENPYV SSGKHAKNSS | | |
| KY511044 | 4592-6247 | gb:KY511044:4592-6247\|Organism:Avian paramyxovirus UPO216\|Strain Name:APMV-15/WB/Kr/UPO216/2014\|Protein Name:fusion protein\|Gene Symbol:F | MIFTMYHVTVLLLLSLLTLPLGIQLARA SIDGRQLAAAGIVVTGEKAINLYTSSQT GTIVVKLLPNVPQGREACMRDPLTSYN KTLTSLLSPLGEAIRRIHESTTETAGLVQ ARLVGAIIGSVALGVATSAQITAAAALI QANKNAENILKLKQSIAATNEAVHEVT DGLSQLAVAVGKMQDFINTQFNNTAQ EIDCIRISQQLGVELNLYLTELTTVFGPQ ITSPALSPLSIQALYNLAGGNLDVLLSKI GVGNNQLSALISSGLISGSPILYDSQTQL LGIQVTLPSVSSLNNMRAIFLETLSVSTD KGFAAALIPKVVTTVGTVTEELDTSYCI ETDIDLFCTRIVTFPMSPGIYACLNGNTS ECMYSKTQGALTTPYMSVKGSIVANCK MTTCRCADPASIISQNYGEAVSLIDSSV CRVITLDGVTLRLSGSFDSTYQKNITIRD SQVIITGSLDISTELGNVNNSINNALDKI EESNQILESVNVSLTSTNALIVYIICTAL ALICGITGLILSCYIMYKMRSQQKTLM WLGNNTLDQMRAQTKM | 1 | 55 |
| NC_025360 | 6104-8123 | gb:NC_025360:6104-8123\|Organism:Atlantic salmon paramyxovirus\|Strain Name:ASPV/Yrkje371/95\|Protein Name:fusion protein\|Gene Symbol:F | MDGPKFRFVLLILLTAPARGQVDYDKL LKVGIFEKGTANLKISVSSQQRYMVIK MMPNLGPMNQCGIKEVNLYKESILRLIT PISTTLNYIKSEIQVEREVALQPNGTIVR FFGLIVAAGALTLATSAQITAGIALHNS LENAKAIKGLTDAIKESNLAIQKIQDAT AGTVIALNALQDQVNTNIIPAINTLGCT AAGNTLGIALTRYYSELIMIFGPSLGNP VEAPLTIQALAGAFNGDLHGMIREYGY TPSDIEDILRTNSVTGRVIDVDLVGMNI VLEINLPTLYTLRDTKIVNLGKITYNVD GSEWQTLVPEWLAIRNTLMGGVDLSRC VVSSRDLICKQDPVFSLDTSIISCLNGNT ESCPRNRVVNSVAPRYAVIRGNILANCI STTCLCGDPGVPIIQKGDNTLTAMSIND CKLVGVDGYVFRPGPKAVNVTFNLPHL NLGPEVNVNPVDISGALGKVEQDLASS RDHLAKSEKILSGINPNIINTEMVLVAVI LSLVCAMVVIGIVCWLSILTKWVRSCR ADCRRPNKGPDLGPIMSSQDNLSF | 1 | 56 |
| UniProt ID: Q9IH63 | | FUS_NIPAV Fusion glycoprotein F0 OS = Nipah virus | MVVILDKRCYCNLLILILMISECSVGILH YEKLSKIGLVKGVTRKYKIKSNPLTKDI VIKMIPNVSNMSQCTGSVMENYKTRLN GILTPIKGALEIYKNNTHDLVGDVRLAG VIMAGVAIGIATAAQITAGVALYEAMK NADNINKLKSSIESTNEAVVKLQETAEK TVYVLTALQDYINTNLVPTIDKISCKQT ELSLDLALSKYLSDLLFVFGPNLQDPVS NSMTIQAISQAFGGNYETLLRTLGYATE DFDDLLESDSITGQIIYVDLSSYYIIVRV YFPILTEIQQAYIQELLPVSFNNDNSEWI SIVPNFILVRNTLISNIEIGFCLITKRSVIC NQDYATPMTNNMRECLTGSTEKCPREL VVSSHVPRFALSNGVLFANCISVTCQCQ TTGRAISQSGEQTLLMIDNTTCPTAVLG NVIISLGKYLGSVNYNSEGIAIGPPVFTD KVDISSQISSMNQSLQQSKDYIKEAQRL LDTVNPSLISMLSMIILYVLSIASLCIGLI TFISFIIVEKKRNTYSRLEDRRVRPTSSG DLYYIGT | | 57 |

In some embodiments, a fusogen described herein comprises an amino acid sequence of Table 2, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to any amino acid sequence of Table 2. In some embodiments, a nucleic acid sequence described herein encodes an amino acid sequence of Table 2, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

In some embodiments, a fusogen described herein comprises an amino acid sequence set forth in any one of SEQ ID NOS: 58-133, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to an amino acid sequence set forth in any one of SEQ ID NOS: 58-133. In some embodiments, a nucleic acid sequence described herein encodes an amino acid sequence set forth in any one of SEQ ID NOS: 58-133, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

TABLE 2

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| KU950686 | 4643-5638 | gb:KU950686:4643-5638\|Organism:Human respiratory syncytial virus\|Strain Name:RSVA/*Homo sapiens*/USA/TH_10506/2014\|Protein Name:attachment glycoprotein\|Gene Symbol:G | MSKTKDQRTAKTLERTWDTLNHLLFISSCLYKLNLKSIAQITLSILAMIISTSLIIAAIIFIASANHKVTLTTAIIQDATNQIKNTTPTYLTQNPQLGISFSNLSGTTLQSTTILASTTPSAESTPQSTTVKIINTTTTQILPSKPTTKQRQNKPQNKPNNDFHFEVFNFVPCSICSNNPTCWAICKRIPNKKPGKKTTTKPTKKPTLKTTKKDPKPQTTKPKEALTTKPTGKPTINTTKTNIRTTLLTSNTKGNPEHTSQEETLHSTTSEGYLSPSQVYTTSGQEETLHSTTSEGYLSPSQVYTTSEYLSQSLSSSNTTK | 706 | 58 |
| AB524405 | 6424-8274 | gb:AB524405:6424-8274\|Organism:Newcastle disease virus\|Strain Name:Goose/Alaska/415/91\|Protein Name:hemagglutinin-neuraminidase protein\|Gene Symbol:HN | MERGVSQVALENDEREAKNTWRLVFRVTVLFLTIVTLAISAAALAFSMNASTPQDLEGIPVAISKVEDKITSALGASQDVMDRIYKQVALESPLALLNTESTIMNALTSLSYQINGAANASGCGAPVPDPDYIGGIGKELIVDDTSDVTSFYPSAFQEHLNFIPAPTTGSGCTRIPSFDMSATHYCYTHNVILSGCRDHSHSHQYLALGVLRTSATGRVFFSTLRSINLDDTQNRKSCSVSATPLGCDMLCSKVTETEEEDYQSTDPTLMVHGRLGFDGQYHERDLDVHTLFGDWVANYPGVGGGSFINNRVWFPVYGGLKPGSPTDKRQEGQYAIYKRYNDTCPDDQEYQVRMAKSAYKPNRFGGKRVQQAILSIGVSTTLADDPVLTVTSNTITLMGAEGRVMTVGTSHYLYQRGSSYYSPAILYPLTIANKTATLQDPYKFNAFTRPGSVPCQASARCPNSCVTGVYTDPYPIVFHKNHTLRGVFGTMLDDEQARLNPVSAVFDSIARSRVTRVSSSSTKAAYTTSTCFKVVKTGKVYCLSIAEISNTLFGEFRIVPLLVEILRDEGRSEARSALTTQGHPGWNDEVVDPIFCAVTNQTDHRQKLEEYAQSWP | 418 | 59 |
| JQ582844 | 4686-5636 | gb:JQ582844:4686-5636\|organism:Human respiratory syncytial virus\|Strain Name:NH1067\|Protein | MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSETHHTTAQTKGRTTTPTQNNKPSTKPRPKNPPKKPKDDYHFEVFNFVPCSICGNNQLCKSICKTIPNNKPKKKPTTKPTNKPPTKTTNKRDPKTPAKTLKKETTINPTTKKPTPKTTERDTSTPQSTVLDTT | 278 | 60 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Name:receptor-binding glycoprotein\|Gene Symbol:G | TSKHTERDTSTPQSTVLDTTTSKHTIQQQSLHSITPENTPNSTQTPTASEPSTSNSTQKL | | |
| AB254456 | 7271-9136 | gb:AB254456:7271-9136\|Organism:Measles virus\|Strain Name:SSPE-Kobe-1\|Protein Name:Hemagglutinin\|Gene Symbol:H | MSPHRDRINAFYRDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVGKPNLSSKGSELSQLSMHRVFEVGVIRNPGLGAPVFHMTNYFEQPVSNDFSNCMVALGELRFAALCHREDSVTVPYQGSGKGVSFQLVKLGVWKSPTDMQSWVPLSTDDPVIDRLYLSSHRGVIADNQAKWAVPTTRTDDKLRMETCFQQACKGKNQALCENPEWAPLKDNRIPSYGVLSVNLSLTVELKIKIASGFGPLITHGSGMDLYKTNHDNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNRRQGCQ | 128 | 61 |
| AB040874 | 6614-8362 | gb:AB040874:6614-8362\|Organism:Mumps virus\|Strain Name:Miyahara\|Protein Name:hemagglutinin-neuraminidase\|Gene Symbol:HN | MEPSKLFTMSDNATFAPGPVINAADKKTFRTCFRILVLSVQAVTLILVIVTLGELVRMINDQGLSNQLSSIADKIRESATMIASAVGVMNQVIHGVTVSLPLQIEGNQNQLLSTLATICTGKKQVSNCSTNIPLVNDLRFINGINKFIIEDYATHDFSIGHPLNMPSFIPTATSPNGCTRIPSFSLGKTHWCYTHNVINANCKDHTSSNQYISMGILVQTASGYPMFKTLKIQYLSDGLNRKSCSIATVPDGCAMYCYVSTQLETDDYAGSSPPTQKLTLLFYNDTVTERTISPTGLEGNWATLVPGVGSGIYFENKLIFPAYGGVLPNSSLGVKSAREFFRPVNPYNPCSGPQQDLDQRALRSYFPSYFSNRRVQSAFLVCAWNQILVTNCELVVPSNNQTLMGAEGRVLLINNRLLYYQRSTSWWPYELLYEISFTFTNSGQSSVNMSWIPIYSFTRPGSGNCSGENVCPTACVSGVYLDPWPLTPYSHQSGINRNFYFTGALLNSSTTRVNPTLYVSALNNLKVLAPYGNQGLFASYTTTTCFQDTGDASVYCVYIMELASNIVGEFQILPVLTRLTIT | 87 | 62 |
| AB736166 | 6709-8427 | gb:AB736166:6709-8427\|Organism:Human respirovirus 3\|Strain Name:ZMLS/2011\|Protein Name:hemagglutinin-neuraminidase\|Gene Symbol:HN | MEYWKHTNHGKDAGNELETATATHGNRLTNKITYILWTITLVLLSIVFIIVLINSIKSEKAHESLLQDINNEFMEVTEKIQVASDNTNDLIQSGVNTRLLTIQSHVQNYIPISLTQQISDLRKFISEITIRNDNQEVPPQRITHDVGIKPLNPDDFWRCTSGLPSLMRTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDGSISTTRFKNNNISFDQPYAALYPSVGPGIYYKGKIIFLGYGGLEHPINENAICNTTGCPGKTQRDCNQASHSPWFSDRRMVNSIIVVDKGLNSVPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNKTLSAGYTTTSCITHYNKGYCFHIVEINHKSLNTFQPMLFKTEIPKSCS | 78 | 63 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| KJ627396 | 6166-6885 | gb:KJ627396:6166-6885\|Organism:Human metapneumovirus\|Strain Name:HMPV/*Homo sapiens*/PER/FLI1305/2010/A\|Protein Name:attachment glycoprotein G\|Gene Symbol:G | MEVKVENIRAIDMLKARVKNRVARSKCFKN ASLILIGITTLSIALNIYLIINYTIQKTTSESEHH TSSPPTESNKETSTIPIDNPDITPNSQHPTQQS TESLTLYPASSMSPSETEPASTPGITNRLSLA DRSTTQPSESRTKTNSTVHKKNKKNISSTISR TQSPPRTTAKAVSRTTALRMSSTGERPTTTS VQSDSSTTAQNHEETGPANPQASVSTM | 71 | 64 |
| AB475097 | 7079-8902 | gb:AB475097:7079-8902\|Organism:Canine distemper virus\|Strain Name:M25CR\|Protein Name:hemagglutinin\|Gene Symbol:H | MLSYQDKVGAFYKDNARANSSKLSLVTEEQ GGRRPPYLLFVLLILLVGILALLAIAGVRFRQ VSTSNVEFGRLLKDDLEKSEAVHHQVMDVL TPLFKIIGDEIGLRLPQKLNEIKQFILQKTNFF NPNREFDFRDLHWCINPPSKIKVNFTNYCDA IGVRKSIASAANPILLSALSGGRGDIFPPYRCS GATTSVGRVFPLSVSLSMSLISKTSEIISMLTA ISDGVYGKTYLLVPDYIEREFDTQKIRVFEIG FIKRWLNDMPLLQTTNYMVLPENSKAKVCT IAVGELTLASLCVDESTVLLYHDSNGSQDSIL VVTLGIFGATPMNQVEEVIPVAHPSVERIHIT NHRGFIKDSVATWMVPALVSEQQEGQKNCL ESACQRKSYPMCNQTSWEPFGGVQLPSYGR LTLPLDASIDLQLNISFTYGPVILNGDGMDY YENPLLDSGWLTIPPKNGTILGLINKASRGD QFTVTPHVLTFAPRESSGNCYLPIQTSQIMDK DVLTESNLVVLPTQNFRYVVATYDISRENHA IVYYVYDPIRTISYTYPFRLTTKGRPDFLRIEC FVWDDDLWCHQFYRFESDITNSTTSVEDLV RIRFSCNRSKP | 45 | 65 |
| AJ849636 | 7326-9155 | gb:AJ849636:7326-9155\|Organism:Peste-des-petits-ruminants virus\|Strain Name:Turkey 2000\|Protein Name:haemagglutinin\|Gene Symbol:H | MSAQRERINAFYKDNPHNKNHRVILDRERL VIERPYILLGVLLVMFLSLIGLLAIAGIRLHRA TVGTSEIQSRLNTNIELTESIDHQTKDVLTPLF KIIGDEVGIRIPQKFSDLVKFISDKIKFLNPDR EYDFRDLRWCMNPPERVKINFDQFCEYKAA VKSIEHIFESPLNKSKKLQSLTLGPGTGCLGR TVTRAHFSELTLTLMDLDLEMKHNVSSVFT VVEEGLFGRTYTVWRSDARDPSTDLGIGHFL RVFEIGLVRDLGLGPPVFHMTNYLTVNMSD DYRRCLLAVGELKLTALCSSSETVTLGERGV PKREPLVVVILNLAGPTLGGELYSVLPTSDL MVEKLYLSSHRGIIKDDEANWVVPSTDVRD LQNKGECLVEACKTRPPSFCNGTGSGPWSE GRIPAYGVIRVSLDLASDPGVVITSVFGPLIP HLSGMDLYNNPFSRAVWLAVPPYEQSFLGM INTIGFPNRAEVMPHILTTEIRGPRGRCHVPIE LSRRVDDDIKIGSNMVILPTIDLRYITATYDV SRSEHAIVYYIYDTGRSSSYFYPVRLNFKGNP LSLRIECFPWRHKVWCYHDCLIYNTITDEEV HTRGLTGIEVTCNPV | 34 | 66 |
| AB005795 | 6693-8420 | gb:AB005795:6693-8420\|Organism:Sendai virus\|Strain Name:Ohita\|Protein Name:hemagglutinin-neuraminidase protein\|Gene Symbol:HN | MDGDRSKRDSYWSTSPGGSTTKLVSDSERS GKVDTWLLILAFTQWALSIATVIICIVIAARQ GYSMERYSMTVEALNTSNKEVKESLTSLIRQ EVITRAANIQSSVQTGIPVLLNKNSRDVIRLIE KSCNRQELTQLCDSTIAVHHAEGIAPLEPHSF WRCPAGEPYLSSDPEVSLLPGPSLLSGSTTIS GCVRLPSLSIGEAIYAYSSNLITQGCADIGKS YQVLQLGYISLNSDMFPDLNPVVSHTYDIND NRKSCSVVATGTRGYQLCSMPIVDERTDYSS DGIEDLVLDILDLKGRTKSHRYSNSEIDLDHP FSALYPSVGSGIATEGSLIFLGYGGLTTPLQG | 23 | 67 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | DTKCRIQGCQQVSQDTCNEALKITWLGGKQ VVSVLIQVNDYLSERPRIRVTTIPITQNYLGA EGRLLKLGDQVYIYTRSSGWHSQLQIGVLD VSHPLTISWTPHEALSRPGNEDCNWYNTCPK ECISGVYTDAYPLSPDAANVATVTLYANTSR VNPTIMYSNTTNIINMLRIKDVQLEAAYTTTS CITHFGKGYCFHIIEINQKSLNTLQPMLFKTSI PKLCKAES | | |
| AF457102 | 6903-8630 | gb:AF457102\|Organism:Human parainfluenza virus 1 strain Washington/1964\|Strain Name:Washington 1964\|Protein Name:HN glycoprotein\|Gene Symbol:HN | MAEKGKTNSSYWSTTRNDNSTVNTHINTPA GRTHIWLLIATTMHTVLSFIIMILCIDLIIKQD TCMKTNIMTVSSMNESAKIIKETITELIRQEVI SRTINIQSSVQSGIPILLNKQSRDLTQLIEKSC NRQELAQICENTIAIHHADGISPLDPHDFWRC PVGEPLLSNNPNISLLPGPSLLSGSTTISGCVR LPSLSIGDAIYAYSSNLITQGCADIGKSYQVL QLGYISLNSDMYPDLNPVISHTYDINDNRKS CSVIAAGTRGYQLCSLPTVNETTDYSSEGIED LVFDILDLKGKTKSHRYKNEDITFDHPFSAM YPSVGSGIKIENTLIFLGYGGLTTPLQGDTKC VINRCTNVNQSVCNDALKITWLKKRQVVNV LIRINNYLSDRPKIVVETIPITQNYLGAEGRLL KLGKKIYIYTRSSGWHSNLQIGSLDINNPMTI KWAPHEVLSRPGNQDCNWYNRCPRECISGV YTDAYPLSPDAVNVATTTLYANTSRVNPTI MYSNTSEIINMLRLKNVQLEAAYTTTSCITH FGKGYCFHIVEINQASLNTLQPMLFKTSIPKI CKITS | 21 | 68 |
| KJ627397 | 6146-6888 | gb:KJ627397:6146-6888\|Organism:Human metapneumovirus\|Strain Name:HMPV/*Homo sapiens*/PER/FPP00098/2010/B\|Protein Name:attachment glycoprotein G\|Gene Symbol:G | MEVRVENIRAIDMFKAKMKNRIRSSKCYRN ATLILIGLTALSMALNIFLIIDYATLKNMTKV EHCVNMPPVEPSKKSPMTSAADLNTKLNPQ QATQLTTEDSTSLAATSENHLHTETTPTSDA TISQQATDEHTTLLRPINRQTTQTTTEKKPTG ATTKKDKEKETTTRTTSTAATQTLNTTNQTS NGREATTTSARSRNGATTQNSDQTIQAADPS SKPYHTQTNTTTAHNTDTSSLSS | 21 | 69 |
| AF017149 | 8913-10727 | gb:AF017149\|Organism: Hendra virus\|Strain Name:UNKNOWN-AF017149\|Protein Name:glycoprotein\|Gene Symbol:G | MMADSKLVSLNNNLSGKIKDQGKVIKNYY GTMDIKKINDGLLDSKILGAFNTVIALLGSIIII VMNIMIIQNYTRTTDNQALIKESLQSVQQQI KALTDKIGTEIGPKVSLIDTSSTITIPANIGLLG SKISQSTSSINENVNDKCKFTLPPLKIHECNIS CPNPLPFREYRPISQGVSDLVGLPNQICLQKT TSTILKPRLISYTLPINTREGVCITDPLLAVDN GFFAYSHLEKIGSCTRGIAKQRIIGVGEVLDR GDKVPSMFMTNVWTPPNPSTIHHCSSTYHE DFYYTLCAVSHVGDPILNSTSWTESLSLIRLA VRPKSDSGDYNQKYIAITKVERGKYDKVMP YGPSGIKQGDTLYFPAVGFLPRTEFQYNDSN CPIIHCKYSKAENCRLSMGVNSKSHYILRSG LLKYNLSLGGDIILQFIEIADNRLTIGSPSKIY NSLGQPVFYQASYSWDTMIKLGDVDTVDPL RVQWRNNSVISRPGQSQCPRFNVCPEVCWE GTYNDAFLIDRLNWVSAGVYLNSNQTAENP VFAVFKDNEILYQVPLAEDDTNAQKTITDCF LLENVIWCISLVEIYDTGDSVIRPKLFAVKIP AQCSES | 14 | 70 |
| AF212302 | 8943-10751 | gb:AF212302\|Organism:Nipah virus\|Strain | MPAENKKVRFENTTSDKGKIPSKVIKSYYGT MDIKKINEGLLDSKILSAFNTVIALLGSIVIIV MNIMIIQNYTRSTDNQAVIKDALQGIQQQIK | 14 | 71 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Name:UNKNOWN-AF212302\|protein Name:attachment glycoprotein\|Gene Symbol:G | GLADKIGTEIGPKVSLIDTSSTITIPANIGLLGS KISQSTASINENVNEKCKFTLPPLKIHECNISC PNPLPFREYRPQTEGVSNLVGLPNNICLQKTS NQILKPKLISYTLPVVGQSGTCITDPLLAMDE GYFAYSHLERIGSCSRGVSKQRIIGVGEVLD RGDEVPSLFMTNVWTPPNPNTVYHCSAVYN NEFYYVLCAVSTVGDPILNSTYWSGSLMMT RLAVKPKSNGGGYNQHQLALRSIEKGRYDK VMPYGPSGIKQGDTLYFPAVGFLVRTEFKY NDSNCPITKCQYSKPENCRLSMGIRPNSHYIL RSGLLKYNLSDGENPKVVFIEISDQRLSIGSP SKIYDSLGQPVFYQASFSWDTMIKFGDVLTV NPLVVNWRNNTVISRPGQSQCPRFNTCPEIC WEGVYNDAFLIDRINWISAGVFLDSNQTAE NPVFTVFKDNEILYRAQLASEDTNAQKTITN CFLLKNKIWCISLVEIYDTGDNVIRPKLFAVK IPEQCT | | |
| EU439428 | 6751-8638 | gb:EU439428:6751-8638\|Organism:Swine parainfluenza virus 3\|Strain Name:92-7783_ISU-92\|Protein Name:hemagglutinin-neuraminidase HN\|Gene Symbol:HN | MEYWKHTNSTKDTNNELGTTRDRHSSKAT NIIMYIFWTTTSTILSVIFIMILINLIQENNHNK LMLQEIKKEFAVIDTKIQKTSDDISTSIQSGIN TRLLTIQSHVQNYIPLSLTQQMSDLRKFINDL TTKREHQEVPIQRMTHDSGIEPLNPDKFWRC TSGNPSLTSSPKIRLIPGPGLLATSTTVNGCIRI PSLAINNLIYAYTSNLITQGCQDIGKSYQVLQ IGIITINSDLVPDLNPRVTHTFNIDDNRKSCSL ALLNTDVYQLCSTPKVDERSDYASTGIEDIV LDIVTSNGLIITTRFTNNNITFDKPYAALYPSV GPGIYYKDKVIFLGYGGLEHEENGDVICNTT GCPGKTQRDCNQASYSPWFSNRRMVNSIIV VDKSIDTTFSLRVWTIPMRQNYWGSEGRLLL LGDRIYIYTRSTSWHSKLQLGVIDISDYNNIRI NWTWHNVLSRPGNDECPWGHSCPDGCITG VYTDAYPLNPSGSVVSSVILDSQKSRENPIIT YSTATNRVNELAIYNRTLPAAYTTTNCITHY DKGYCFHIVEINHRSLNTFQPMLFKTEVPKN CS | 14 | 72 |
| KF530164 | 6157-6906 | gb:KF530164:6157-6906\|Organism:Human metapneumovirus\|Strain Name:HMPV/AUS/172832788/2004/B\|Protein Name:attachment glycoprotein G\|Gene Symbol:G | MEVRVENIRAIDMFKAKIKNRIRSSRCYRNA TLILIGLTALSMALNIFLIIDHATLRNMIKTEN CANMPSAEPSKKTPMTSTAGPSTKPNPQQAT QWTTENSTSPAATLEGHPYTGTTQTPDTTAP QQTTDKHTALPKSTNEQITQTTTEKKTTRAT TQKREKRKENTNQTTSTAATQTTNTTNQTR NASETITTSDGPRIDTTTQSSEQTARATEPGS SPYHARRGAGPR | 14 | 73 |
| AB910309 | 6960-8747 | gb:AB910309:6960-8747\|Organism:Feline morbillivirus\|Strain Name:SS1\|Protein Name:hemagglutinin protein\|Gene Symbol:H | MKNINIKYYKDSNRYLGKILDEHKIVNSQLY SLSIKVITIIAIIVSLIATIMTIINATSGRTTLNS NTDILLNQRDEIHSIHEMIFDRVYPLITAMST ELGLHIPTLLDELTKAIDQKIKIMNPPVDTVT SDLSWCIKPPNGIIIDPKGYCESMELSKTYKL LLDQLDVSRKKSLTINRKNINQCQLVDDSEII FATVNIQSTPRFLNFGHTVSNQRITFGQGTYS STYILTIQEDGITDVQYRVFEIGYISDQFGVFP SLIVSRVLPIRMVLGMESCTLTSDRQGGYFL CMNTLTRSIYDYVNIRDLKSLYITLPHYGKV NYTYFNFGKIRSPHEIDKLWLTSDRGQIISGY FAAFVTITIRNYNNYPYKCLNNPCFDNSENY CRGWYKNITGTDDVPILAYLLVEMYDEEGP LITLVAIPPYNYTAPSHNSLYYDDKINKLIMT TSHIGYIQINEVHEVIVGDNLKAILLNRLSDE HPNLTACRLNQGIKEQYKSDGMIISNSALIDI QERMYITVKAIPPVGNYNFTVELHSRSNTSYI | 12 | 74 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | LLPKQFNAKYDKLHLECFNWDKSWWCALIP QFSLSWNESLSVDTAIFNLINCK | | |
| AB759118 | 7116-8957 | gb:AB759118:7116-8957\| Organism:Avian paramyxovirus 6\|Strain Name:red-necked stint/Japan/8 KS0813/2008\| Protein Name:hemagglutinin-neuraminidase\| Gene Symbol:HN | MASPSELNRSQATLYEGDPNSKRTWRTVYR ASTLILDLAILCVSIVAIVRMSTLTPSDVTDSI SSSITSLSDTYQSVWSDTHQKVNSIFKEVGISI PVTLDKMQVEMGTAVNIITDAVRQLQGVNG SAGFSITNSPEYSGGIDALIYPQKSLNGKSLAI SDLLEHPSFIPAPTTSHGCTRIPTFHLGYRHW CYSHNTIESGCHDAGESIMYLSMGAVGVGH QGKPVFTTSAAVILDDGKNRKSCSVVANPN GCDVLCSLVKQTEDQDYADPTPTPMIHGRL HFNGTYTESMLDQSLFTGHWVAQYPAVGS GSVSHGRLFFPLYGGISKsSSLFPKLRAHAYF THNEELECKNLTSKQREDLFNAYMPGKIAG SLWAQGIVICNLTTLADCKIAVANTSTMMM AAEGRLQLVQDKVVLYQRSSSWWPVLIYY DILVSELVNARHLDIVNWVPYPQSKFPRPTW TKGLCEKPSICPAVCVTGVYQDVWVVSVGD FSNETVVIGGYLEAASERKDPWIAAANQYN WLTRRQLFTAQTEAAYSSTTCFRNTHQDKV FCLTIMEVTDNLLGDWRIAPLLYEVTVVDR QQSSRKAVAMSEAHRTRFKYYSPENKFTPQ H | 11 | 75 |
| AY141760 | 6791-8485 | gb:AY141760\| Organism:Fer-de-Lance paramyxovirus\| Strain Name:ATCC VR-895\|Protein Name:hemagglutinin-neuraminidase protein HN\|Gene Symbol:HN | MDPKSYYCNEDLRSDGGEKSPGGDLYKGIIL VSTVISLIIAIISLAFIIDNKINIQSLDPLRGLED SYLVPIKDKSESISQDIQEGIFPRLNLITAATT TTIPRSIAIQTKDLSDLIMNRCYPSVVNNDTS CDVLAGAIHSNLFSQLDPSTYWTCSSGTPTM NQTVKLLPDNSQIPGSTYSTGCVRIPTFSLGS MIYSYSHNVIYEGCNDHSKSSQYWQLGYIST SKTGEPLQQVSRTLTLNNGLNRKSCSTVAQ GRGAYLLCTNVVEDERTDYSTEGIQDLTLD YIDIFGAERSYRYTNNEVDLDRPYAALYPSV GSGTVYNDRILFLGYGGLMTPYGDQAMCQ APECTSATQEGCNSNQLIGYFSGRQIVNCIIEI ITVGTEKPIIRVRTIPNSQVWLGAEGRIQTLG GVLYLYIRSSGWHALAQTGIILTLDPIRISWI VNTGYSRPGNGPCSASSRCPAQCITGVYTDI FPLSQNYGYLATVTLLSGVDRVNPVISYGTS TGRVADSQLTSSSQVAAYTTTTCFTFNQKG YCYHIIELSPATLGIFQPVLVVTEIPKICS | 8 | 76 |
| EU877976 | 6248-8161 | gb:EU877976:6248-8161\| Organism:Avian paramyxovirus 4\|Strain Name:APMV-4/KR/YJ/061 Protein Name:hemagglutinin-neuraminidase\| Gene Symbol:HN | MQGNMEGSRDNLTVDDELKTTWRLAYRVV SLLLMVSALIISIVILTRDNSQSIITAINQSSDA DSKWQTGIEGKITSIMTDTLDTRNAALLHIPL QLNTLEANLLSALGGNTGIGPGDLEHCRYPV HDTAYLHGVNRLLINQTADYTAEGPLDHVN FIPAPVTTTGCTRIPSFSVSSSIWCYTHNVIET GCNDHSGSNQYISMGVIKRAGNGLPYFSTV VSKYLTDGLNRKSCSVAAGSGHCYLLCSLV SEPEPDDYVSPDPTPMRLGVLTWDGSYTEQ AVPERIFKNIWSANYPGVGSGAIVGNKVLFP FYGGVRNGSTPEVMNRGRYYYIQDPNDYCP DPLQDQILRAEQSYYPTRFGRRMVMQGVLA CPVSNNSTIASQCQSYYFNNSLGFIGAESRIY YLNGNIYLYQRSSSWWPHPQIYLLDSRIASP GTQNIDSGVNLKMLNVTVITRPSSGFCNSQS RCPNDCLFGVYSDIWPLSLTSDSIFAFTMYL QGKTTRIDPAWALFSNHAIGHEARLFNKEVS AAYSTTTCFSDTIQNQVYCLSILEVRSELLGA FKIVPFLYRVL | 8 | 77 |
| AB176531 | 6821-8536 | gb:AB176531:6821-8536\| Organism:Human parainfluenza | MEDYSNLSLKSIPKRTCRIIFRTATILGICTLIV LCSSILHEIIHLDVSSGLMDSDDSQQGIIQPIIE SLKSLIALANQILYNVAIIIPLKIDSIETVIFSAL KDMHTGSMSNTNCTPGNLLLHDAAYINGIN | 7 | 78 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | virus 2\|Strain Name:Nishio\| Protein Name:hemagglutinin-neuraminidase protein\|Gene Symbol:HN | KFLVLKSYNGTPKYGPLLNIPSFIPSATSPNG CTRIPSFSLIKTHWCYTHNVMLGDCLDFTTS NQYLAMGIIQQSAAAFPIFRTMKTIYLSDGIN RKSCSVTAIPGGCVLYCYVATRSEKEDYATT DLAELRLAFYYYNDTFIERVISLPNTTGQWA TINPAVGSGIYHLGFILFPVYGGLISGTPSYN KQSSRYFIPKHPNITCAGNSSEQAAAARSSY VIRYHSNRLIQSAVLICPLSDMHTARCNLVM FNNSQVMMGAEGRLYVIDNNLYYYQRSSS WWSASLFYRINTDFSKGIPPIIEAQWVPSYQV PRPGVMPCNATSFCPANCITGVYADVWPLN DPEPTSQNALNPNYRFAGAFLRNESNRTNPT FYTASASALLNTTGFNNTNHKAAYTSSTCFK NTGTQKIYCLIIIEMGSSLLGEFQIIPFLRELIP | | |
| AF052755 | 6584-8281 | gb:AF052755\| Organism:Parainfluenza virus 5\|Strain Name:W3A\| Protein Name:hemagglutinin-neuraminidase protein\|Gene Symbol:HN | MVAEDAPVRATCRVLFRTTTLIFLCTLLALSI SILYESLITQKQIMSQAGSTGSNSGLGSITDLL NNILSVANQIIYNSAVALPLQLDTLESTLLTA IKSLQTSDKLEQNCSWSAALINDNRYINGIN QFYFSIAEGRNLTLGPLLNMPSFIPTATTPEG CTRIPSFSLTKTHWCYTHNVILNGCQDHVSS NQFVSMGIIEPTSAGFPFFRTLKTLYLSDGVN RKSCSISTVPGGCMMYCFVSTQPERDDYFSA APPEQRIIIMYYNDTIVERIINPPGVLDVWAT LNPGTGSGVYYLGWVLFPIYGGVIKGTSLW NNQANKYFIPQMVAALCSQNQATQVQNAK SSYYSSWFGNRMIQSGILACPLRQDLTNECL VLPFSNDQVLMGAEGRLYMYGDSVYYYQR SNSWWPMTMLYKVTITFTNGQPSAISAQNV PTQQVPRPGTGDCSATNRCPGFCLTGVYAD AWLLTNPSSTSTFGSEATFTGSYLNTATQRIN PTMYIANNTQIISSQQFGSSGQEAAYGHTTCF RDTGSVMVYCIYIIELSSSLLGQFQIVPFIRQV TLS | 7 | 79 |
| BK005918 | 6560-8290 | gb:BK005918\| Organism:porcine rubulavirus\| Strain Name:UNKNOWN-BK005918\| Protein Name:attachment protein\|Gene Symbol:HN | MSQLGTDQIMHLAQPAIARRTWRLCFRIFAL FILIAIVITQIFMLTFDHTLLTTTQFLTSIGNLQ STITSWTPDVQAMLSISNQLIYTTSITLPLKIS TTEMSILTAIRDHCHCPDCSSACPTRQMLLN DPRYMSGVNQFIGAPTESINITFGPLFGIPSFIP TSTTTQGCTRIPSFALGPSHWCYTHNFITAGC ADGGHSNQYLAMGTIQSASDGSPLLITARSY YLSDGVNRKSCSIAVVPGGCAMYCYVATRS ETDYYAGNSPPQQLLTLVFSNDTIIERTIHPT GLANGWVMLVPGVGSGTLYNEYLLFPAYG GMQQILANQSGEINQFFTPYNATVRCAMAQ PQFSQRAAASYYPRYFSNRWIRSAIVACPYR AIYQTQCTLIPLPNRMVMMGSEGRIFTLGDR LFYYQRSSSWWPYPLLYQVGLNFLTTPPSVS SMTQVPLEHLARPGKGGCPGNSHCPATCVT GVYADVWPLTDPRSGVGGTSLVAAGGLDST SERMAPVNYLAIGESLLSKTYLLSKTQPAAY TTTTCFRDTDTGKIYCITIAELGKVLLGEFQI VPFLREIKIQSRY | 7 | 80 |
| EU338414 | 6015-7913 | gb:EU338414:6015-7913\| Organism:Avian paramyxovirus 2\|Strain Name:APMV-2/Chicken/California/Yucaipa/56\|Protein Name:hemagglutinin-neuraminidase\| Gene Symbol:HN | MDFPSRENLAAGDISGRKTWRLLFRILTLSIG VVCLAINIATIAKLDHLDNMASNTWTTTEA DRVISSITTPLKVPVNQINDMFRIVALDLPLQ MTSLQKEITSQVGFLAESINNVLSKNGSAGL VLVNDPEYAGGIAVSLYQGDASAGLNFQPIS LIEHPSFVPGPTTAKGCIRIPTFHMGPSHWCY SHNIIASGCQDASHSSMYISLGVLKASQTGSP IFLTTASHLVDDNINRKSCSIVASKYGCDILC SIVIETENEDYRSDPATSMIIGRLFFNGSYTES KINTGSIFSLFSANYPAVGSGIVVGDEAAFPI YGGVKQNTWLFNQLKDFGYFTHNDVYKCN RTDIQQTILDAYRPPKISGRLWVQGILLCPVS LRPDPGCRLKVFNTSNVMMGAEARLIQVGS | 7 | 81 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | TVYLYQRSSSWWVVGLTYKLDVSEITSQTG NTLNHVDPIAHTKFPRPSFRRDACARPNICPA VCVSGVYQDIWPISTATNNSNIVWVGQYLE AFYSRKDPRIGIATQYEWKVTNQLFNSNTEG GYSTTTCFRNTKRDKAYCVVISEYADGVFG SYRIVPQLIEIRTTTGKSE | | |
| KC403973 | 6234-6964 | gb:KC403973:6234-6964\|Organism:Human metapneumovirus\|Strain Name:HMPV/USA/TN-82-518/1982/A\|Protein Name:attachment glycoprotein G\|Gene Symbol:G\|Segment: 8 | MEVKVENIRTIDMLKARVKNRVARSKCFKN ASLILIGITTLSIALNIYLIINYTMQENTSESEH HTSSSPMESSRETPTVPIDNSDTNPSSQYPTQ QSTEGSTLYFAASASSPETEPTSTPDTTSRPPF VDTHTTPPSASRTKTSPAVHTKNNPRISSRTH SPPWAMTRTVRRTTTLRTSSIRKRSSTASVQ PDSSATTHKHEEASPVSPQTSASTTRPQRKS MEASTSTTYNQTS | 6 | 82 |
| KF015281 | 4511-5844 | gb:KF015281:4511-5844\|Organism:Canine pneumovirus\|Strain Name:dog/Bari/100-12/ITA/2012\|Protein Name:attachment protein\|Gene Symbol:G | MRPAEQLIQENYKLTSLSMGRNFEVSGSTTN LNFERTQYPDTFRAVVKVNQMCKLIAGVLT SAAVAVCVGVIMYSVFTSNHKANSMQNATI RNSTSAPPQPTAGPPTTEQGTTPKFTKPPTKT TTHHEITEPAKMVTPSEDPYQCSSNGYLDRP DLPEDFKLVLDVICKPPGPEHHSTNCYEKREI NLGSVCPDLVTMKANMGLNNGGGEEAAPY IEVITLSTYSNKRAMCVHNGCDQGFCFFLSG LSTDQKRAVLELGGQQAIMELHYDSYWKH YWSNSNCVVPRTNCNLTDQTVILFPSFNNKN QSQCTTCADSAGLDNKFYLTCDGLSRNLPL VGLPSLSPQAHKAALKQSTGTTTAPTPETRN PTPAPRRSKPLSRKKRALCGVDSSREPKPTM PYWCPMLQLFPRRSNS | 6 | 83 |
| KF973339 | 4624-5310 | gb:KF973339:4624-5310\|Organism:Respiratory syncytial virus type A\|Strain Name:RSV-A/US/BID-V7358/2002\|Protein Name:truncated attachment glycoprotein\|Gene Symbol:G | MSKTKDQRAAKTLEKTWDTLNHLLFISSCL YKSNLKSIAQITLSILAMTIPTSLIIVATTFIAS ANNKVTPTTAIIQDATSQIKNTTPTHLTQNPQ PGISFFNLSGTISQTTAILAPTTPSVEPILQSTT VKTKNTTTTQIQPSKLTTKQRQNKPPNKPND DFHFEVFNFVPCSICSNNPTCWAICKRIPSKK PGKKTTTKPTKKQTIKTTKKDLKPQTTKPKE APTT | 6 | 84 |
| FJ215864 | 6383-8116 | gb:FJ215864:6383-8116\|Organism:Avian paramyxovirus 8\|Strain Name:pintail/Walcuya/20/78\|Protein Name:hemagglutinin-neuraminidase protein\|Gene Symbol:HN | MSNIASSLENIVEQDSRKTTWRAIFRWSVLLI TTGCLALSIVSIVQIGNLKIPSVGDLADEVVT PLKTTLSDTLRNPINQINDIFRIVALDIPLQVT SIQKDLASQFSMLIDSLNAIKLGNGTNLIIPTS DKEYAGGIGNPVFTVDAGGSIGFKQFSLIEHP SFIAGPTTTRGCTRIPTFHMSESHWCYSHNII AAGCQDASASSMYISMGVLHVSSSGTPIFLT TASELIDDGVNRKSCSIVATQFGCDILCSIVIE KEGDDYWSDTPTPMRHGRFSFNGSFVETEL PVSSMFSSFSANYPAVGSGEIVKDRILFPIYG GIKQTSPEFTELVKYGLFVSTPTTVCQSSWT YDQVKAAYRPDYISGRFWAQVILSCALDAV DLSSCIVKIMNSSTVMMAAEGRIIKIGIDYFY YQRSSSWWPLAFVTKLDPQELADTNSIWLT | 5 | 85 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | NSIPIPQSKFPRPSYSENYCTKPAVCPATCVT GVYSDIWPLTSSSSLPSIIWIGQYLDAPVGRT YPRFGIANQSHWYLQEDILPTSTASAYSTTT CFKNTARNRVFCVTIAEFADGLFGEYRITPQ LYELVRNN | | |
| JX857409 | 6619-8542 | gb:JX857409:6619-8542\|Organism:Porcine parainfluenza virus 1\|Strain Name:5206N\|Protein Name:haemagglutinin protein\|Gene Symbol:H | MEETKVKTSEYWARSPQIHATNHPNVQNRE KIKEILTILISFISSLSLVLVIAVLIMQSLHNGTI LRCKDVGLESINKSTYSISNAILDVIKQELITR IINTQSSVQVALPILINKKIQDLSLIIEKSSKVH QNSPTCSGVAALTHVEGIKPLDPDDYWRCPS GEPYLEDELTLSLIPGPSMLAGTSTIDGCVRL PSLAIGKSLYAYSSNLITKGCQDIGKSYQVLQ LGIITLNSDLHPDLNPIISHTYDINDNRKSCSV AVSETKGYQLCSMPRVNEKTDYTSDGIEDIV FDVLDLKGSSRSFKFSNNDINFDHPFSALYPS VGSGIIWKNELYFLGYGALTTALQGNTKCN LMGCPGATQDNCNKFISSSWLYSKQMVNVL IQVKGYLSSKPSIIVRTIPITENYVGAEGKLVG TRERIYIYTRSTGWHTNLQIGVLNINHPITIT WTDHRVLSRPGRSPCAWNNKCPRNCTTGV YTDAYPISPDANYVATVTLLSNSTRNNPTIM YSSSDRVYNMLRLRNTELEAAYTTTSCIVHF DRGYCFHIIEINQKELNTLQPMLFKTAIPKAC RISNL | 5 | 86 |
| KF908238 | 7510-9249 | gb:KF908238:7510-9249\|Organism:Human parainfluenza virus 4b\|Strain Name:QLD-01\|Protein Name:hemagglutinin-neuraminidase protein\|Gene Symbol:HN | MQDSRGNTQIFSQANSMVKRTWRLLFRIVT LILLISIFVLSLIIVLQSTPGNLQSDVDIIRKEL DELMENFETTSKSLLSVANQITYDVSVLTPIR QEATETNIIAKIKDHCKDRVVKGESTCTLGH KPLHDVSFLNGFNKFYFTYRDNVQIRLNPLL DYPNFIPTATTPHGCIRIPSFSLSQTHWCYTH NTILRGCEDTASSKQYVSLGTLQTLENGDPY FKVEYSHYLNDRKNRKSCSVVAVLDGCLLY CVIMTKNETENFKDPQLATQLLTYIYSYNGTI KERIINPPGSSRDWVHISPGVGSGILYSNYIIF PLYGGLMENSMIYNNQSGKYFFPNSTKLPCS NKTSEKITGAKDSYTITYFSKRLIQSAFLICDL RQFLSEDCEILIPSNDHMLVGAEGRLYNIEN NIFYYQRGSSWWPYPSLYRIKLNSNKKYPRII EIKFTKIEIAPRPGNKDCPGNKACPKECITGV YQDIWPLSYPNTAFPHKKRAYYTGFYLNNS LARRNPTFYTADNLDYHQQERLGKFNLTAG YSTTTCFKQTTTARLYCLYILEVGDSVIGDF QIFPFLRSIDQAIT | 5 | 87 |
| KT071757 | 6066-7962 | gb:KT071757:6066-7962\|Organism:Avian paramyxovirus 2\|Strain Name:APMV-2/Emberiza spodocephala/China/Daxing'anling/974/2013\|Protein Name:hemagglutinin-neuraminidase protein\|Gene Symbol:HN | MDALSRENLTEISQGGRRTWRMLFRILTLVL TLVCLAINIATIAKLDSIDTSKVQTWTTTESD RVIGSLTDTLKIPINQVNDMFRIVALDLPLQM TTLQKEIASQVGFLAESINNFLSKNGSAGSVL VNDPEYAGGIGTSLFHGDSASGLDFEAPSLIE HPSFIPGPTTAKGCIRIPTFHMSASHWCYSHN IIASGCQDAGHSSMYISMGVLKATQAGSPSF LTTASQLVDDKLNRKSCSIISTTYGCDILCSL VVENEDADYRSDPPTDMILGRLFFNGTYSES KLNTSAIFQLFSANYPAVGSGIVLGDEIAFPV YGGVKQNTWLFNQLKDYGYFAHNNVYKC NNSNIHQTVLNAYRPPKISGRLWSQVVLICP MRLFINTDCRIKVFNTSTVMMGAEARLIQVG SDIYLYQRSSSWWVVGLTYKLDFQELSSKT GNILNNVSPIAHAKFPRPSYSRDACARPNICP AVCVSGVYQDIWPISTAHNLSQVVWVGQYL EAFYARKDPWIGIATQYDWKKNVRLFNANT EGGYSTTTCFRNTKRDKAFCVIISEYADGVF GSYRIVPQLIEIRTTSKKGLPS | 5 | 88 |
| LC041132 | 6605-8437 | gb:LC041132:6605-8437\| | MQPGISEVSFVNDERSERGTWRLLFRILTIVL CLTSIGIGIPALIYSKEAATSGDIDKSLEAVKT | 4 | 89 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Organism:Avian paramyxovirus goose/Shimane/ 67/2000\| Strain Name:goose/ Shimane/67/ 2000\|Protein Name:hemagglutinin-neuraminidase\| Gene Symbol:HN | GMSTLSSKIDESINTEQKIYRQVILEAPVSQL NMESNILSAITSLSYQIDGTSNSSGCGSPMHD QDFVGGINKEIWTTDNVNLGEITLTPFLEHL NFIPAPTTGNGCTRIPSFDLGLTHWCYTHNVI LSGCQDYSSSFQYIALGVLKISATGHVFLST MRSINLDDERNRKSCSISATSIGCDIICSLVTE REVDDYNSPAATPMIHGRLDFSGKYNEVDL NVGQLFGDWSANYPGVGGGSFLNGRVWFPI YGGVKEGTPTFKENDGRYAIYTRYNDTCPD SESEQVSRAKSSYRPSYFGGKLVQQAVLSIKI DDTLGLDPVLTISNNSITLMGAESRVLQIEEK LYFYQRGTSWFPSLIMYPLTVDDKMVRFEPP TIFDQFTRPGNHPCSADSRCPNACVTGVYTD GYPIVFHNNHSIAAVYGMQLNDVTNRLNPR SAVWYGVSMSNVIRVSSSTTKAAYTTSTCF KVKKTQRVYCLSIGEIGNTLFGEFRIVPLLLE VYSEKGKSLKSSFDGWEDISINNPLRPLDNH RVDPILISNYTSSWP | | |
| AF092942 | 4705-5478 | gb:AF092942\| Organism:Bovine respiratory syncytial virus\|Strain Name:ATue51908\| Protein Name:attachment glycoprotein\| Gene Symbol:G | MSNHTHHLKFKTLKRAWKASKYFIVGLSCL YKFNLKSLVQTALTTLAMITLTSLVITAIIYIS VGNAKAKPTSKPTIQQTQQPQNHTSPFFTEH NYKSTHTSIQSTTLSQLPNTDTTRETTYSHSI NETQNRKIKSQSTLPATRKPPINPSGSNPPEN HQDHNNSQTLPYVPCSTCEGNLACLSLCQIG PERAPSRAPTITLKKTPKPKTTKKPTKTTIHH RTSPEAKLQPKNNTAAPQQGILSSPEHHTNQ STTQI | 3 | 90 |
| AF326114 | 6691-847 | gb:AF326114\| Organism:Menangle virus\|Strain Name:UNKNOWN-AF326114\| Protein Name:attachment protein\|Gene Symbol:HN | MWNSIPQLVSDHEEAKGKFTDIPLQDDTDSQ HPSGSKSTCRTLFRTVSIILSLVILVLGVTSTM FSAKYSGGCATNSQLLGVSNLINQIQKSIDSL ISEVNQVSITTAVTLPIKIMDFGKSVTDQVTQ MIRQCNTVCKGPGQKPGSQNVRIMPSNNLS TFQNINMSARGIAYQDVPLTFVRPIKNPQSCS RFPSYSVSFGVHCFANAVTDQTCELNQNTFY RVVLSVSKGNISDPSSLETKAETRTPKGTPVR TCSIISSVYGCYLLCSKATVPESEEMKTIGFS QMFILYLSMDSKRIIYDNIVSSTSAIWSGLYP GEGAGIWHMGQLFFPLWGGIPFLTPLGQKIL NSTLDIPEVGSKCKSDLTSNPAKTKDMLFSP YYGENVMVFGFLTCYLLSNVPTNCHADYLN STVLGFGSKAQFYDYRGIVYMYIQSAGWYP FTQIFRITLQLKQNRLQAKSIKRIEVTSTTRPG NRECSVLRNCPYICATGLFQVPWIVNSDAITS KEVDNMVFVQAWAADFTEFRKGILSLCSQV SCPINDLLSKDNSYMRDTTTYCFPQTVPNILS CTSFVEWGGDSGNPINILEIHYEVIFVAS | 3 | 91 |
| GU206351 | 7500-9714 | gb:GU206351:7500-9714\| Organism:Avian paramyxovirus 5\|Strain Name:budgerigar/ Kunitachi/ 74\|Protein Name:hemagglutinin neuraminidase protein\|Gene Symbol:HN | MDKSYYTEPEDQRGNSRTWRLLFRLIVLTLL CLIACTSVSQLFYPWLPQVLSTLISLNSSIITSS NGLKKEILNQNIKEDLIYREVAINIPLTLDRV TVEVGTAVNQITDALRQLQSVNGSAAFALS NSPDYSGGIEHLVFQRNTLINRSVSVSDLIEH PSFIPTPTTQHGCTRIPTFHLGTRHWCYSHNII GQGCADSGASMMYISMGALGVSSLGTPTFT TSATSILSDSLNRKSCSIVATTEGCDVLCSIVT QTEDQDYADHTPTPMIHGRLWFNGTYTERS LSQSLFLGTWAAQYPAVGSGIMTPGRVIFPF YGGVIPNSPLFLDLERFALFTHNGDLECRNL TQYQKEAIYSAYKPPKIRGSLWAQGFIVCSV GDMGNCSLKVINTSTVMMGAEGRLQLVGD SVMYYQRSSSWWPVGILYRLSLVDIIARDIQ VVINSEPLPLSKFPRPTWTPGVCQKPNVCPA VCVTGVYQDLWAISAGETLSEMTFFGGYLE ASTQRKDPWIGVANQYSWFMRRRLFKTSTE | 3 | 92 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | AAYSSSTCFRNTRLDRNFCLLIFELTDNLLGD WRIVPLLFELTIV | | |
| JQ001776 | 8170-10275 | gb:JQ001776:8170-10275\|Organism:Cedar virus\|Strain Name:CG1a\|Protein Name:attachment glycoprotein\|Gene Symbol:G | MLSQLQKNYLDNSNQQGDKMNNPDKKLSV NFNPLELDKGQKDLNKSYYVKNKNYNVSNLLNE SLHDIKFCIYCIFSLLIIITIINIITISIVITRL KVHEENNGMESPNLQSIQDSLSSLTNMINTEI TPRIGILVTATSVTLSSSINYVGTKTNQLVNE LKDYITKSCGFKVPELKLHECNISCADPKISK SAMYSTNAYAELAGPPKIFCKSVSKDPDFRL KQIDYVIPVQQDRSICMNNPLLDISDGFFTYI HYEGINSCKKSDSFKVLLSHGEIVDRGDYRP SLYLLSSHYHPYSMQVINCVPVTCNQSSFVF CHISNNTKTLDNSDYSSDEYYITYFNGIDRPK TKKIPINNMTADNRYIHFTFSGGGGVCLGEE FIIPVTTVINTDVFTHDYCESFNCSVQTGKSL KEICSESLRSPTNSSRYNLNGIMIISQNNMTD FKIQLNGITYNKLSFGSPGRLSKTLGQVLYY QSSMSWDTYLKAGFVEKWKPFTPNWMNNT VISRPNQGNCPRYHKCPEICYGGTYNDIAPL DLGKDMYVSVILDSDQLAENPEITVFNSTTIL YKERVSKDELNTRSTTTSCFLFLDEPWCISVL ETNRFNGKSIRPEIYSYKIPKYC | 3 | 93 |
| KP271123 | 6644-8431 | gb:KP271123:6644-8431\|Organism:Teviot virus\|Strain Name:Geelong\|Protein Name:attachment protein\|Gene Symbol:HN | MWSTQASKHPAMVNSATNLVDIPLDHPSSA QFPINRKRTGRLIYRLFSILCNLILISILISLVVI WSRSSRDCAKSDGLSSVDNQLSSLSRSINSLI TEVNQISVTTAINLPIKLSEFGKSVVDQVTQ MIRQCNAACKGPGEKPGIQNVRINIPNNFST YSELNRTANSLNFQSRTALFARPNPYPKTCS RFPSYSVYFGIHCFSHAVTDSSCELSDSTYYR LVIGVADKNLSDPADVKYIGETTTPVRVQTR GCSVVSSIYGCYLLCSKSNQDYQDDFREQGF HQMFILFLSRELKTTFFDDMVSSTTVTWNGL YPGEGSGIWHMGHLVFPLWGGIRFGTHASE GILNSTLELPPVGPSCKRSLADNGLINKDVLF SPYFGDSVMVFAYLSCYMLSNVPTHCQVET MNSSVLGFGSRAQFYDLKGIVYLYIQSAGW FSYTQLFRLSLQSKGYKLSVKQIKRIPISSTSR PGTEPCDIIHNCPYTCATGLFQAPWIVNGDSI RDRDVRNMAFVQAWSGAINTFQRPFMSICS QYSCPLSELLDSESSIMRSTTTYCFPSLTESIL QCVSFIEWGGPVGNPISINEVYSSISFRPD | 3 | 94 |
| AY286409 | 7644-9542 | gb:AY286409\|Organism:Mossman virus\|Strain Name:UNKNOWN-AY286409\|Protein Name:attachment glycoprotein\|Gene Symbol:G | MVDPPAVSYYTGTGRNDRVKVVTTQSTNPY WAHNPNQGLRRLIDMVVNVIMVTGVIFALI NIILGIVIISQSAGSRQDTSKSLDIIQHVDSSVA ITKQIVMENLEPKIRSILDSVSFQIPKLLSSLL GPGKTDPPIALPTKASTPVIPTEYPSLNTTTCL RIEESVTQNAAALFNISFDLKTVMYELVTRT IPGGCVTLPSYSELYTRVRTFSTAIRNPKTCQR AGQETDLNLIPAFIGTDTGILINSCVRQPVIAT GDGIYALTYLTMRGTCQDHRHAVRHFEIGL VRRDAWWDPVLTPIHHFTEPGTPVFDGCSLT VQNQTALALCTLTTDGPETDIHNGASLGLAL VHFNIRGEFSKHKVDPRNIDTQNQGLHLVTT AGKSAVKKGILYSFGYMVTRSPEPGDSKCV TEECNQNNQEKCNAYSKTTLDPDKPRSMIIF QIDVGAEYFTVDKVVVVPRTQYYQLTSGDL FYTGEENDLLYQLHNKGWYNKPIRGRVTFD GQVTLHEHSRTYDSLSNQRACNPRLGCPSTC ELTSMASYFPLDKDFKAAVGVIALRNGMTPI ITYSTDDWRNHWKYIKNADLEFSESSLSCYS PNPPLDDYVLCTAVITAKVMSNTNPQLLATS WYQYDKCHT | 2 | 95 |
| AY900001 | 7809-9938 | gb:AY900001\|Organism:J- | MNPVAMSNFYGINQADHLREKGDQPEKGPS VLTYVSLITGLLSLFTIIALNVTNIIYLTGSGG | 2 | 96 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | virus\|Strain Name:UNKNOWN-AY900001\|Protein Name:attachment glycoprotein\|Gene Symbol:G | TMATIKDNQQSMSGSMRDISGMLVEDLKPK TDLINSMVSYTIPSQISAMSAMIKNEVLRQCT PSFMFNNTICPIAEHPVHTSYFEEVGIEAISMC TGTNRKLVVNQGINFVEYPSFIPGSTKPGGC VRLPSFSLGLEVFAYAHAITQDDCTSSSTPDY YFSVGRIADHGTDVPVFETLAEWFLDDKMN RRSCSVTAAGKGGWLGCSILVGSFTDELTSP EVNRISLSYMDTFGKKKDWLYTGSEVRADQ SWSALFFSVGSGVVIGDTVYFLVWGGLNHPI NVDAMCRAPGCQSPTQSLCNYAIKPQEWGG NQIVNGILHFKHDTNEKPTLHVRTLSPDNNW MGAEGRLFHFHNSGKTFIYTRSSTWHTLPQV GILTLGWPLSVQWVDITSISRPGQSPCEYDN RCPHQCVTGVYTDLFPLGVSYEYSVTAYLD QVQSRMNPKIALVGAQEKIYEKTITTNTQHA DYTTTSCFAYKLRVWCVSIVEMSPGVITTRQ PVPFLYHLNLGCQDTSTGSLTPLDAHGGTYL NTDPVGNKVDCYFVLHEGQIYFGMSVGPIN YTYSIVGRSREIGANMNVSLNQLCHSVYTEF LKEKEHPGTRNNIDVEGWLLKRIETLNGTKI FGLDDLEGSGPGHQSGPEDPSIAPIGHN | | |
| EF199772 | 6150-6944 | gb:EF199772:6150-6944\|Organism:Avian metapneumovirus\|Strain Name:PL-2\|Protein Name:attachment glycoprotein\|Gene Symbol:G | MEVKVENVGKSQELKVKVKNFIKRSDCKK KLFALILGLVSFELTMNIMLSVMYVESNEAL SLCRIQGTPAPRDNKTNTENATKETTLHTTT TTRDPEVRETKTTKPQANEGATNPSRNLTTK GDKHQTTRATTEAELEKQSKQTTEPGTSTQ KHTPARPSSKSPTTTQATAQPTTPTAPKAST APKNRQATTKKTETDTTTASRARNTNNPTE TATTTPKATTETGKGKEGPTQHTTKEQPETT ARETTTPQPRRTAGASPRAS | 2 | 97 |
| JF424833 | 5981-7156 | gb:JF424833:5981-7156\|Organism:Avian metapneumovirus\|Strain Name:IT/Ty/A/259-01/03\|Protein Name:attachment protein\|Gene Symbol:G | MGSKLYMVQGTSAYQTAVGFWLDIGRRYIL AIVLSAFGLTCTVTIALTVSVIVEQSVLEECR NYNGGDRDWWSTTQEQPTTAPSATPAGNY GGLQTARTRKSESCLHVQISYGDMYSRSDT VLGGFDCMGLLVLCKSGPICQRDNQVDPTA LCHCRVDLSSVDCCKVNKISTNSSTTSEPQK TNPAWPSQDNTDSDPNPQGITTSTATLLSTSL GLMLTSKTGTHKSGPPQALPGSNTNGKTTT DRELGSTNQPNSTTNGQHNKHTQRMTLPPS YDNTRTILQHTTPWEKTFSTYKPTHSPTNES DQSLPTTQNSINCEHFDPQGKEKICYRVGSY NSNITKQCRIDVPLCSTYNTVCMKTYYTEPF NCWRRIWRCLCDDGVGLVEWCCTS | 2 | 98 |
| JN689227 | 7918-12444 | gb:JN689227:7918-12444\|Organism:Tailam virus\|Strain Name:TL8K\|Protein Name:attachment glycoprotein\|Gene Symbol:G | MSQLAAHNLAMSNFYGIHQGGQSTSQKEEE QPVQGVIRYASMIVGLLSLFTIIALNVTNIIY MTESGGTMQSIKNAQGSIDGSMKDLSGTIM EDIKPKTDLINSMVSYNIPAQLSMIHQIIKND VLKQCTPSFMFNNTICPLAENPTHSRYFEEV NLDSISECSGNEMSLELGTEPEFIEYPSFAPGS TKPGSCVRLPSFSLSSTVFAYTHTIMGHGCSE LDVGDHYLAIGRIADAGHEIPQFETISSWFIN DKINRRSCTVAAGVMETWMGCVIMTETFY DDLDSLDTGKITISYLDVFGRKKEWIYTRSEI LYDYTYTSVYFSIGSGVVVGDTVYFLLWGS LSSPIEETAYCYAPGCSNYNQRMCNEAQRPA KFGHRQMANAILRFKTNSMGKPSISVRTLSP TVIPFGTEGRLIYSDFTKIIYLYLRSTSWYVLP LTGLLILGPPVSISWVTQEAVSRPGEYPCGAS NRCPKDCITGVYTDLFPLGARYEYAVTVYL NAETYRVNPTLALIDRSKIIARKKITTESQKA GYTTTTCFVFKLRIWCMSVVELAPATMTAF EPVPFLYQLDLTCKRNNGTTAMQFSGQDGM YKSGRYKSPRNECFFEKVSNKYYFVVSTPEG | 2 | 99 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | IQPYEVRDLTPERVSHVIMYISDVCAPALSAF KKLIPAMRPITTLTIGNWQFRPVDISGGLRVN IYRNLTRYGDLSMSAPEDPGTDTFPGTHAPS KGHEEVGHYTLPNEKLSEVTTAAVKTKESL NLIPDTKDTRGEEENGSGLNEIITGHTTPGHI KTHPAETKVTKHTVIIPQIEEDGSGATTSTEL QDETGYHTEDYNTTNTNGSLTAPNERNNYT SGDHTVSGEDITHTITVSDRTKTTQTLPTDNT FNQTPTKIQEGSPKSESTPKDYTAIESEDSHF TDPTLIRSTPEGTIVQVIGDQFHSAVTQLGES NAIGNSEPIDQGNNLIPTTDRGTMDNTSSQS HSSTTSTQGSHSAGHGSQSNMNLTALADTD SVTDQSTSTQEIDHEHENVSSILNPLSRHTRV MRDTVQEALTGAWGFIRGMIP | | |
| KC562242 | 6178-6926 | gb:KC562242:6178-6926\|Organism:Human metapneumovirus\|Strain Name:HMPV/USA/C1-334/2004/B\|Protein Name:attachment glycoprotein G\|Gene Symbol:G | MEVRVENIRAIDMFKAKIKNRIRNSRCYRNA TLILIGLTALSMALNIFLIIDHATLRNMIKTEN CANMPSAEPSKKTPMTSIAGPSTKPNPQQAT QWTTENSTSPAATLEGHPYTGTTQTPDTTAP QQTTDKHTALPKSTNEQITQTTTEKKTRAT TQKRKKEKKTQTKPQVQLQPKQPTPPTKSE MQVRQSQHPTDPELTPLPKAVNRQPGQQNQ APHHIMHGEVQDPGERNTQVSHPSS | 2 | 100 |
| KC915036 | 6154-7911 | gb:KC915036:6154-7911\|Organism:Avian metapneumo virus type C\|Strain Name:GDY\|Protein Name:attachment glycoprotein\|Gene Symbol:G | MEVKIENVGKSQELRVKVKNFIKRSDCKKK LFALILGLISFDITMNIMLSVMYVESNEALSS CRVQGTPAPRDNRTNTENTAKETTLHTMTT TRNTEAGGTKTTKPQADERATSPSKNPTIGA DKHKTTRATTEAEQEKQSKQTTEPGTSTPKH IPARPSSKSPATTKTTTQPTTPTVAKGGTAPK NRQTTTKKTEADTPTTSRAKQTNKPTGTETT PPRATTETDKDKEGPTQHTTKEQPETTAGGT TTPQPRRTTSRPAPTTNTKEGAETTGTRTTKS TQTSASPPRPTRSTPSKTATGTNKRATTTKGP NTASTDRRQQTRTTPKQDQQTQTKAKTTTN KAHAKAATTPEHNTDTTDSMKENSKEDKTT RDPSSKATTKQENTSKGTTATNLGNNTEAG ARTPPTTTPTRHTTEPATSTAGGHTKARTTR WKSTAARQPTRNNTTADTKTAQSKQTTPAQ LGNNTTPENTTPPDNKSNSQTNVAPTEEIEIG SSLWRRRYVYGPCRENALEHPMNPCLKDNT TWIYLDNGRNLPAGYYDSKTDKIICYGIYRG NSYCYGRIECTCKNGTGLLSYCCNSYNWS | 2 | 101 |
| LC168749 | 7239-9196 | gb:LC168749:7239-9196\|Organism:Rinderpest morbillivirus\|Strain Name:Lv\|Protein Name:H protein\|Gene Symbol:H | MSSPRDRVNAFYKDNLQFKNTRVVLNKEQL LIERPYMLLAVLFVMFLSLVGLLAIAGIRLHR AAVNTAEINSGLTTSIDITKSIEYQVKDVLTP LFKIIGDEVGLRTPQRFTDLTKFISDKIKFLNP DKEYDFRDINWCISPPERIKINYDQYCAHTA AEELITMLVNSSLAGTAVLRTSLVNLGRSCT GSTTTKGQFSNMSLALSGIYSGRGYNISSMIT ITEKGMYGSTYLVGKHNQGARRPSTAWQR DYRVFEVGIIRELGVGTPVFHMTNYLELPRQ PELEICMLALGEFKLAALCLADNSVALHYG GLRDDHKIRFVKLGVWPSPADSDTLATLSA VDPTLDGLYITTHRGIIAAGKAVWAVPVTRT DDQRKMGQCRREACREKPPPFCNSTDWEPL EAGRIPAYGILTIRLGLADKPEIDIISEFGPLIT HDSGMDLYTPLDGNEYWLTIPPLQNSALGT VNTLVLEPSLKISPNILTLPIRSGGGDCYTPTY LSDLADDDVKLSSNLVILPSRNLQYVSATYD TSRVEHAIVYYIYSTGRLSSYYYPVKLPIKGD | | |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | PVSLQIGCFPWGLKLWCHHFCSVIDSGTGKQ VTHTGAVGIEITCNSR | | |
| LC187310 | 8144-9871 | gb:LC187310:8144-9871\|Organism:Avian paramyxovirus 10\|Strain Name:rAPMV-10-FI324/YmHA\|Protein Name:hemagglutinin-neuraminidase\|Gene Symbol:HN | MDSSQMNILDAMDRESSKRTWRGVFRVTTII MVVTCVVLSAITLSKVAHPQGFDTNELGNGI VDRVSDKITEALTVPNNQIGEIFKIVALDLHV LVSSSQQAIAGQIGMLAESINSILSQNGSASTI LSSSPEYAGGIGVPLFSNKLTNGTVIKPITLIE HPSFIPGPTTIGGCTRIPTFHMASSHWCYSHN IIEKGCKDSGISSMYISLGVLQVLKKGTPVFL VTASAVLSDDRNRKSCSIISSRFGCEILCSLVT EAESDDYKSDTPTGMVHGRLYFNGTYREGL VDTETIFRDFSANYPGVGSGEIVEGHIHFPIY GGVKQNTGLYNSLTPYWLDAKNKYDYCKL PYTNQTIQNSYKPPFIHGRFWAQGILSCELDL FNLGNCNLKIIRSDKVMMGAESRLMLVGSK LLMYQRASSWWPLGITQEIDIAELHSSNTTIL REVKPILSSKFPRPSYQPNYCTKPSVCPAVCV TGVYTDMWPISITGNISDYAWISHYLDAPTS RQQPRIGIANQYFWIHQTTIFPTNTQSSYSTT TCFRNQVRSRMFCLSIAEFADGVFGEFRIVPL LYELRV | 2 | 103 |
| NC_004074 | 6590-8563 | gb:NC_004074:6590-8563\|Organism:Tioman virus\|Strain Name:UNKNOWN-NC_0040741 Protein Name:attachment protein\|Gene Symbol:HN | MWATSESKAPIPANSTLNLVDVPLDEPQTIT KHRKQKRTGRLVFRLLSLVLSLMTVILVLVI LASWSQKINACATKEGFNSLDLQISGLVKSI NSLITEVNQISITTAINLPIKLSDFGKSIVDQVT QMIRQCNAVCKGPGEKPGIQNIRINIPNNFST YLELNNTVKSIELQRRPALLARPNPIPKSCSR FPSYSVNFGIHCFAHAITDQSCELSDKTYYRL AIGISDKNLSDPSDVKYIGEAFTPMGLQARG CSVISSIYGCYLLCSKSNQGYEADFQTQGFH QMYILFLSRDLKTTLFNDMISSTTVVWNGLY PGEGAGIWHMGYLIFPLWGGIKIGTPASTSIL NSTLDLPLVGPSCKSTLEENNLINKDVLFSPY FGESVMVFGFLSCYMLSNVPTHCQVEVLNS SVLGFGSRSQLMDLKGIVYLYIQSAGWYSY TQLFRLSLQSRGYKLTVKQIRRIPISSTTRPGT APCDVVHNCPYTCATGLFQAPWIVNGDSIL DRDVRNLVFVQAWSGNFNTFQKGLISICNQ YTCPLTTLLDNDNSIMRSTTTYCYPSLSEYN LQCQSFIEWGGPVGNPIGILEVHYIIKFK | 2 | 104 |
| NC_005283 | 7091-8905 | gb:NC_005283:7091-8905\|Organism:Dolphin morbillivirus\|Strain Name:UNKNOWN-NC_005283 Protein Name:haemagglutinin protein\|Gene Symbol:H | MSSPRDKVDAFYKDIPRPRNNRVLLDNERVI IERPLILVGVLAVMFLSLVGLLAIAGVRLQK ATTNSIEVNRKLSTNLETTVSIEHHVKDVLTP LFKIIGDEVGLRMPQKLTEIMQFISNKIKFLN PDREYDFNDLHWCVNPPDQVKIDYAQYCN HIAAEELIVTKFKELMNHSLDMSKGRIFPPK NCSGSVITRGQTIKPGLTLVNIYTTRNFEVSF MVTVISGGMYGKTYFLKPPEPDDPFEFQAFR IIFEVGLVRDVGSREPVLQMTNFMVIDEDEGL NFCLLSVGELRLAAVCVRGRPVVTKDIGGY KDEPFKVVTLGIIGGGLSNQKTEIYPTIDSSIE KLYITSHRGIIRNSKARWSVPAIRSDDKDKM EKCTQALCKSRPPPSCNSSDWEPLTSNRIPAY AYIALEIKEDSGLELDITSNYGPLIIHGAGMDI YEGPSSNQDWLAIPPLSQSVLGVINKVDFTA GFDIKPHTLTTAVDYESGKCYVPVELSGAKD QDLKLESNLVVLPTKDFGYVTATYDTSRSE HAIVYYVYDTARSSSYFFPFRIKARGEPIYLR IECFPWSRQLWCHHYCMINSTVSNEIVVVDN LVSINMSCSR | 2 | 105 |
| NC_007803 | 7978-12504 | gb:NC_007803:7978-12504\|Organism:Beilong virus\|Strain | MSQLAAHNLAMSNFYGTHQGDLSGSQKGE EQQVQGVIRYVSMIVSLLSLFTIIALNVTNIIY MTESGGTMQSIKTAQGSIDGSMREISGVIME DVKPKTDLINSMVSYNIPAQLSMIHQIIKNDV | 2 | 106 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Name:Li\|Protein Name:attachment glycoprotein\| Gene Symbol:G | PKQCTPSFMFNNTICPLAENPTHSRYFEEVNL DSISECSGPDMHLGLGVNPEFIEFPSFAPGST KPGSCVRLPSFSLSTTVFAYTHTIMGHGCSEL DVGDHYFSVGRIADAGHEIPQFETISSWFIND KINRRSCTVAAGAMEAWMGCVIMTETFYD DRNSLDTGKLTISYLDVFGRKKEWIYTRSEIL YDYTYTSVYFSVGSGVVVGDTVYFLIWGSL SSPIEETAYCFAPDCSNYNQRMCNEAQRPSK FGHRQMVNGILKFKTTSTGKPLLSVGTLSPS VVPFGSEGRLMYSEITKIIYLYLRSTSWHALP LTGLFVLGPPTSISWIVQRAVSRPGEFPCGAS NRCPKDCVTGVYTDLFPLGSRYEYAATVYL NSETYRVNPTLALINQTNIIASKKVTTESQRA GYTTTTCFVFKLRVWCISVVELAPSTMTAYE PIPFLYQLDLTCKGKNGSLAMRFAGKEGTY KSGRYKSPRNECFFEKVSNKYYFIVSTPEGIQ PYEIRDLTPDRMPHIIMYISDVCAPALSAFKK LLPAMRPITTLTIGNWQFRPVEVSGGLRVNI GRNLTKEGDLTMSAPEDPGSNTFPGNHIPGN GILDAGYYTVEYPKE | | |
| NC_009489 | 6559-8512 | gb:NC_009489:6559-8512\| Organism:Mapuera virus\|Strain Name:BeAnn 370284\|Protein Name:attachment protein\|Gene Symbol:HN | MASLQSEPGSQKPHYQSDDQLVKRTWRSFF RFSVLVVTITSLALSIITLIGVNRISTAKQISNA FAAIQANILSSIPDIRPINSLLNQLVYTSSVTLP LRISSLESNVLAAIQEACTYRDSQSSCSATMS VMNDQRYIEGIQVYSGSFLDLQKHTLSPPIAF PSFIPTSTTTVGCTRIPSFSLTKTHWCYTHNYI KTGCRDATQSNQYIALGTIYTDPDGTPGFST SRSQYLNDGVNRKSCSISAVPMGCALYCFIS VKEEVDYYKGTVPPAQTLILFFFNGTVHEHR IVPSSMNSEWVMLSPGVGSGVFYNNYIIFPL YGGMTKDKAEKRGELTRFFTPKNSRSLCKM NDSVFSNAAQSAYYPPYFSSRWIRSGLLACN WNQIITTNCEILTFSNQVMMMGAEGRLILIN DDLFYYQRSTSWWPRPLVYKLDIELNYPDS HIQRVDQVEVTFPTRPGWGGCVGNNFCPMI CVSGVYQDVWPVTNPVNTTDSRTLWVGGT LLSNTTRENPASVVTSGGSISQTVSWFNQTV PGAYSTTTCFNDQVQGRIFCLIIFEVGGGLLG EYQIVPFLKELKYQGAVHA | 2 | 107 |
| NC_017937 | 6334-8544 | gb:NC_017937:6334-8544\| Organism:Nariva virus\|Strain Name:UNKNOWN-NC_017937\| Protein Name:attachment protein\|Gene Symbol:H | MAPINYPASYYTNNAERPVVITTKSTESKGQ RPLPLGNARFWEYFGHVCGTLTFCMSLIGIIV GIIALANYSSDKDWKGRIGGDIQVTRMATEK TVKLILEDTTPKLRNILDSVLFQLPKMLASIA SKINTQTPPPPTTSGHSTALATQCSSNCENRP EIGYDYLRQVEQSLQRITNISIQLLEASEIHSM AGAYPNALYKIRTQDSWSVTAKECPLQAFQ PNLNLIPAMIGTATGALIRNCVRQPVIVVDD GVYMLTYLAMRGSCQDHQKSVRHFEMGVI TSDPFGDPVPTPLRHWTKRALPAYDGCALA VKGHAGFALCTETSVGPLRDRTAKRKPNIVL FKASLVGELSERVIPPQSWLSGFSFFSVYTVA GKGYAYHSKFHAFGNVVRVGQSEYQAKCR GTGCPTANQDDCNTAQRVSQEDNTYLHQAI LSVDIDSVIDPEDVVYVIERDQYYQASAGDL YRVPETGEILYNLHNGGWSNEVQVGRIQPS DRFYMREIQLTSTRVPAPNGCNRVKGCPGG CVAVISPAFTPMHPEFNVGVGIFPMNQPHNP SIMHVQQQTELFWKPIVGGNITLHESSIACYS TVPPNPSYDLCIGVMTLLLHQGQLPQFQALS WYQPTMCNGNAPQNRRALIPVIVEDSKAMS VSSDAPRTP | 2 | 108 |
| NC_025256 | 9117-11015 | gb:NC_025256:9117-11015\| Organism:Bat Paramyxovirus | MPQKTVEFINMNSPLERGVSTLSDKKTLNQS KITKQGYFGLGSHSERNWKKQKNQNDHYM TVSTMILEILVVLGIMFNLIVLTMVYYQNDNI NQRMAELTSNITVLNLNLNQLTNKIQREIIPR | 2 | 109 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Eid_hel/GH-M74a/GHA/2009\|Strain Name:BatPV/Eid_hel/GH-M74a/GHA/2009\|Protein Name:glycoprotein\|Gene Symbol:G | ITLIDTATTITIPSAITYILATLTTRISELLPSINQKCEFKTPTLVLNDCRINCTPPLNPSDGVKMSSLATNLVAHGPSPCRNFSSVPTIYYYRIPGLYNRTALDERCILNPRLTISSTKFAYVHSEYDKNCTRGFKYYELMTFGEILEGPEKEPRMFSRSFYSPTNAVNYHSCTPIVTVNEGYFLCLECTSSDPLYKANLSNSTFHLVILRHNKDEKIVSMPSFNLSTDQEYVQIIPAEGGGTAESGNLYFPCIGRLLHKRVTHPLCKKSNCSRTDDESCLKSYYNQGSPQHQVVNCLIRIRNAQRDNPTWDVITVDLTNTYPGSRSRIFGSFSKPMLYQSSVSWHTLLQVAEITDLDKYQLDWLDTPYISRPGGSECPFGNYCPTVCWEGTYNDVYSLTPNNDLFVTVYLKSEQVAENPYFAIFSRDQILKEFPLDAWISSARTTTISCFMFNNEIWCIAALEITRLNDDIIRPIYYSFWLPTDCRTPYPHTGKMTRVPLRSTYNY | | |
| NC_025347 | 6398-8418 | gb:NC_025347:6398-8418\|Organism:Avian paramyxovirus 7\|Strain Name:APMV-7/dove/Tennessee/4/75\|Protein Name:hemagglutinin-neuraminidase\|Gene Symbol:HN | MESIGKGTWRTVYRVLTILLDVVIIILSVIALISLGLKPGERIINEVNGSIHNQLVPLSGITSDIQAKVSSIYRSNLLSIPLQLDQINQAISSSARQIADTINSFLALNGSGTFIYTNSPEFANGFNRAMFPTLNQSLNMLTPGNLIEFTNFIPTPTTKSGCIRIPSFSMSSSHWCYTHNIIASGCQDHSTSSEYISMGVVEVTDQAYPNFRTTLSITLADNLNRKSCSIAATGFGCDILCSVVTETENDDYQSPEPTQMIYGRLFFNGTYSEMSLNVNQMFADWVANYPAVGSGVELADFVIFPLYGGVKITSTLGASLSQYYYIPKVPTVNCSETDAQQIEKAKASYSPPKVAPNIWAQAVVRCNKSVNLANSCEILTFNTSTMMMGAEGRLLMIGKNVYFYQRSSSYWPVGIIYKLDLQELTTFSSNQLLSTIPIPFEKFPRPASTAGVCSKPNVCPAVCQTGVYQDLWVLYDLGKLENTTAVGLYLNSAVGRMNPFIGIANTLSWYNTTRLFAQGTPASYSTTTCFKNTKIDTAYCLSILELSDSLLGSWRITPLLYNITLSIMS | 2 | 110 |
| NC_025348 | 6590-8548 | gb:NC_025348:6590-8548\|Organism:Tuhoko virus 2\|Strain Name:UNKNOWN-NC_025348\|Protein Name:hemagglutinin-neuraminidase\|Gene Symbol:HN | MPPVPTVSQSIDEGSFTDIPLSPDDIKHPLSKKTCRKLFRIVTLIGVGLISILTIISLAQQTGILRKVDSSDFQSYVQESFKQVLNLMKQFSSNLNSLIEITSVTLPFRIDQFGTDIKTQVAQLVRQCNAVCRGPIKGPTTQNIVYPALYETSLNKTLETKNVRIQEVRQEVDPVPGPGLSNGCTRNPSFSVYHGVWCYTHATSIGNCNGSLGTSQLFRIGNVLEGDGGAPYHKSLATHLLTTRNVSRQCSATASYYGCYFICSEPVLTERDDYETPGIEPITIFRLDPDGNWVVFPNINRFTEYSLKALYPGIGSGVLFQGKLIFPMYGGIDKERLSALGLGNIGLIERRMADTCNHTEKELGRSFPGAFSSPYYHDAVMLNFLLICEMIENLPGDCDLQILNPTNMSMGSESQLSVLDNELFLYQRSASWWPYTLIYRLNMRYTGKYLKPKSIIPMVIKSNTRPGYEGCNHERVCPKVCVTGVFQAPWILSIGRDHKERVSNVTYMVAWSMDKSDRTYPAVSVCGSDTCKLTVPLGDSKVHSAYSVTRCYLSRDHMSAYCLVIFELDARPWAEMRIQSFLYKLILT | 2 | 111 |
| NC_025350 | 6451-8341 | gb:NC_025350:6451-8341\|Organism:Tuhoko virus 3\|Strain Name:UNKNOWN-NC_0253501 Protein Name:hemagglutinin-neuraminidase\|Gene | MHNRTQSVSSIDTSSDVYLPRRKKAVTKFTFKKIFRVLILTLLLSIIIIIAVIFPKIDHIRETCDNSQILETITNQNSEIKNLINSAITNLNVLLTSTTVDLPIKLNNFGKSIVDQVTMMVRQCNAVCRGPGDRPTQNIELFKGLYHTSPPSNTSTKLSMITEASNPDDIVPRPGKLLGCTRFPSFSVHYGLWCYGHMASTGNCSCGSSPSVQIIRIGSIGTNKDGTPKYVIIASASLPETTRLYHCSVTMTSIGCYILCTTPSVSETDDYSTMGIEKNISISFLSLDGYLTQLGQPTGLDNQNLYALYPGPGSGVIFRDFLI | 2 | 112 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Symbol:HN | FPMMGGIRLMDAQKMLNRNITYRGFPPSET CTESELKLKQEVANMLTSPYYGEVLVLNFL YVCSLLDNIPGDCSVQLIPPDNMTLGAESRL YVLNGSLIMYKRGSSWWPYTELYQINYRVN NRAFRVRESVRINTTSTSRPGVQGCNLEKVC PKVCVSGIYQSPGIISAPVNPTRQEEGLLYFL VWTSSMSSRTGPLSSLCDHSTCRITYPIGDDT IFIGYTDSSCFMSSIKEGIYCIAFLELDNQPYS MMAIRSLSYIIN | | |
| NC_025352 | 8716-11257 | gb:NC_025352:8716-11257\|Organism:Mojiang virus\|Strain Name:Tongguan1\|Protein Name:attachment glycoprotein\|Gene Symbol:G | MATNRDNTITSAEVSQEDKVKKYYGVETAE KVADSISGNKVFILMNTLLILTGAIITITLNIT NLTAAKSQQNMLKIIQDDVNAKLEMFVNLD QLVKGEIKPKVSLINTAVSVSIPGQISNLQTK FLQKYVYLEESITKQCTCNPLSGIFPTSGPTY PPTDKPDDDTTDDDKVDTTIKPIEYPKPDGC NRTGDHFTMEPGANFYTVPNLGPASSNSDE CYTNPSFSIGSSIYMFSQEIRKTDCTAGEILSI QIVLGRIVDKGQQGPQASPLLVWAVPNPKII NSCAVAAGDEMGWVLCSVTLTAASGEPIPH MFDGFWLYKLEPDTEVVSYRITGYAYLLDK QYDSVFIGKGGGIQKGNDLYFQMYGLSRNR QSFKALCEHGSCLGTGGGGYQVLCDRAVM SFGSEESLITNAYLKVNDLASGKPVIIGQTFP PSDSYKGSNGRMYTIGDKYGLYLAPSSWNR YLRFGITPDISVRSTTWLKSQDPIMKILSTCT NTDRDMCPEICNTRGYQDIFPLSEDSEYYTYI GITPNNGGTKNFVAVRDSDGHIASIDILQNY YSITSATISCFMYKDEIWCIAITEGKKQKDNP QRIYAHSYKIRQMCYNMKSATVTVGNAKNI TIRRY | 2 | 113 |
| NC_025363 | 6503-8347 | gb:NC_025363:6503-8347\|Organism:Avian paramyxovirus 12\|Strain Name:Wigeon/Italy/3920_1/2005\|Protein Name:hemagglutinin-neuraminidase\|Gene Symbol:HN | MESATSQVSFENDKTSDRRTWRAVFRVLMII LALSSLCVTVAALIYSAKAAIPGNIDASEQRI LSSVEAVQVPVSRLEDTSQKIYRQVILEAPVT QLNMETNILNAITSLSYQIDASANSSGCGAP VHDSDFTGGVGRELLQEAEVNLTIIRPSKFLE HLNFIPAPTTGNGCTRIPSFDLGQTHWCYTH NVVLNGCRDRGHSFQYVALGILRTSATGSV FLSTLRSVNLDDDRNRKSCSVSATPIGCEML CSLVTETEEGDYDSIDPTPMVHGRLGFDGKY REVDLSEKEIFADWRANYPAVGGGAFFGNR VWFPVYGGLKEGTQSERDAEKGYAIYKRFN NTCPDDNTTQIANAKASYRPSRFGGRFIQQG ILSFKVEGNLGSDPILSLTDNSITLMGAEARV MNIENKLYLYQRGTSWFPSALVYPLDVANT AVKVRAPYIFDKFTRPGGHPCSASSRCPNVC VTGVYTDAYPLVFSRSHDIVAVYGMQLAAG TARLDPQAAIWYGNEMSTPTKVSSSTTKAA YTTSTCFKVTKTKRIYCISIAEIGNTLFGEFRI VPLLIEVQKTPLTRRSELRQQMPQPPIDLVID NPFCAPSGNLSRKNAIDEYANSWP | 2 | 114 |
| NC_025373 | 6619-8605 | gb:NC_025373:6619-8605\|Organism:Avian paramyxovirus 3\|Strain Name:turkey/Wisconsin/68\|Protein Name:hemagglutinin\|Gene Symbol:HN | MEPTGSKVDIVPSQGTKRTCRTFYRLLILILN LIIIILTIISIYVSISTDQHKLCNNEADSLLHSIV EPITVPLGTDSDVEDELREIRRDTGINIPIQID NTENIILTTLASINSNIARLHNATDESPTCLSP VNDPRFIAGINKITKGSMIYRNFSNLIEHVNFI PSPTTLSGCTRIPSFSLSKTHWCYSHNVISTG CQDHAASSQYISIGIVDTGLNNEPYLRTMSS RLLNDGLNRKSCSVTAGAGVCWLLCSVVTE SESADYRSRAPTAMILGRFNFYGDYTESPVP ASLFSGRFTANYPGVGSGTQLNGTLYFPIYG GVVNDSDIELSNRGKSFRPRNPTNPCPDPEV TQSQRAQASYYPTRFGRLLIQQAILACRISDT TCTDYYLLYFDNNQVMMGAEARIYYLNNQ MYLYQRSSSWWPHPLFYRFSLPHCEPMSVC MITDTHLILTYATSRPGTSICTGASRCPNNCV | 2 | 115 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | DGVYTDVWPLTEGTTQDPDSYYTVFLNSPN RRISPTISIYSYNQKISSRLAVGSEIGAAYTTS TCFSRTDTGALYCITIIEAVNTIFGQYRIVPIL VQLISD | | |
| NC_025386 | 7541-9403 | gb:NC_025386:7541-9403\|Organism:Salem virus\|Strain Name:UNKNOWN-NC_025386\|Protein Name:attachment glycoprotein\|Gene Symbol:G | MKAMHYYKNDFADPGTNDNSSDLTTNPFIS NQIKSNLSPPVLAEGHLSPSPIPKFRKILLTISF VSTIVVLTVILLVLTIRILTIIEASAGDEKDIHT ILSSLLNTFMNEYIPVFKNLVSIISLQIPQMLID LKTSSTQMMQSLKTFPRDLETLSTVTQSVAV LLEKAKSTIPDINKFYKNVGKVTFNDPNIKV LTLEVPAWLPIVRQCLKQDFRQVISNSTGFA LIGALPSQLFNEFEGYPSLAIVSEVYAITYLK GVMFENQENFLYQYFEIGTISPDGYNKPYFL RHTSVMLSTFKLSGKCTAAVDYRGGIFLCTP SPKIPKILQNPPDLPTLTVVSIPFDGRYTIRNIS LMLTDEADIIYDLDTLQGRGVLQAMRFYAL VRVISSSSPRHFPFCKNSWCPTADDKICDQSR RLGADGNYPVMYGLISIPAHSSYQGNVSLKL IDPKYYAYTRDASLFYNSMTDTYHYSFGTR GWVSRPIIGELLLGDDIVLTRYTVRSVSRAT AGDCTTVSMCPQACSGGMNSIFYPLNFDKP QVTGVAIRQYERQQEGIIVVTMNDHYYYSV PIIKNGTLLISSVTDCFWLMGDLWCMSLMEK NNLPLGVRSLAHLTWNIHWSCS | 2 | 116 |
| NC_025390 | 6647-8386 | gb:NC_025390:6647-8386\|Organism:Avian paramyxovirus 9\|Strain Name:duck/New York/22/1978\|Protein Name:hemagglutinin-neuraminidase\|Gene Symbol:HN | MESGISQASLVNDNIELRNTWRTAFRVVSLL LGFTSLVLTACALHFALNAATPADLSSIPVA VDQSHHEILQTLSLMSDIGNKIYKQVALDSP VALLNTESTLMSAITSLSYQINNAANNSGCG APVHDKDFINGVAKELFVGSQYNASNYRPS RFLEHLNFIPAPTTGKGCTRIPSFDLAATHWC YTHNVILNGCNDHAQSYQYISLGILKVSATG NVFLSTLRSINLDDDENRKSCSISATPLGCDL LCAKVTEREEADYNSDAATRLVHGRLGFDG VYHEQALPVESLFSDWVANYPSVGGGSYFD NRVWFGVYGGIRPGSQTDLLQSEKYAIYRR YNNTCPDNNPTQIERAKSSYRPQRFGQRLVQ QAILSIRVEPSLGNDPKLSVLDNTVVLMGAE ARIMTFGHVALMYQRGSSYFPSALLYPLSLT NGSAAASKPFIFEQYTRPGSPPCQATARCPNS CVTGVYTDAYPLFWSEDHKVNGVYGMML DDITSRLNPVAAIFDRYGRSRVTRVSSSSTKA AYTTNTCFKVVKTKRVYCLSIAEIENTLFGE FRITPLLSEIIFDPNLEPSDTSRN | 2 | 117 |
| NC_025403 | 6692-8645 | gb:NC_025403:6692-8645\|Organism:Achimota virus 1\|Strain Name:UNKNOWN-NC_025403\|Protein Name:attachment protein\|Gene Symbol:HN | MATNLSTITNGKFSQNSDEGSLTELPFFEHN RKVATTKRTCRFVFRSVITLCNLTILIVTVVV LFQQAGFIKRTESNQVCETLQNDMHGVVTM SKGVITTLNNLIEITSVNLPFQMKQFGQGIVT QVTQMVRQCNAVCKGPTIGPDIQNIVYPASY ESMIKHPVNNSNILLSEIRQPLNFVPNTGKLN GCTRTPSFSVYNGFWCYTHAESDWNCNGSS PYMQVFRVGVVTSDYDYNVIHKTLHTKTSR LANVTYQCSTISTGYECYFLCSTPNVDEITDY KTPGIESLQIYKIDNRGTFAKFPITDQLNKEL LTALYPGPGNGVLYQGRLLFPMHGGMQSSE LNKVNLNNTVLSQFNDNKGCNATEIKLESEF PGTFTSPYYSNQVMLNYILICEMIENLPGNC DLQIVAPKNMSMGSESQLYSINNKLYLYQRS SSRWPYPLIYEVGTRLTNRQFRLRAINRFLIK STTRPGSEGCNIYRVCPKVCVTGVYQAPWIL HVSKAGSQSIAKVLYAVAWSKDHMSRKGP LFSICDNDTCFLTKSLASEHVHSGYSITRCYL ENSERHIICVVIMELDASPWAEMRIQSVIYNI TLPS | 2 | 118 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| NC_025404 | 6655-8586 | gb:NC_025404:6655-8586\|Organism:Achimota virus 2\|Strain Name:UNKNOWN-NC_025404\|Protein Name:attachment protein\|Gene Symbol:HN | MDNSMSISTISLDAQPRIWSRHESRRTWRNIF RITSLVLLGVTVIICIWLCCEVARESELELLAS PLGALIMAINTIKSSVVKMTTELNQVTFTTSII LPNKVDQFGQNVVSQVAQLVKQCNAVCRG HQDTPELEQFINQKNPTWILQPNYTTKLTNL HEIDSIIPLVDYPGFSKSCTRFPSFSEGSKFWC FTYAVVKEPCSDISSSIQVVKYGAIKANHSD GNPYLVLGTKVLDDGKFRRGCSITSSLYGCY LLCSTANVSEVNDYAHTPAYPLTLELISKDGI TTDLSPTYTVQLDKWSALYPGIGSGVIFKGY LMFPVYGGLPFKSPLISASWVGPGNKWPVD FSCSEDQYSTFNFSNPYSALYSPHFSNNIVVS ALFVCPLNENLPYSCEVQVLPQGNLTIGAEG RLYVIDQDLYYYQRSTSWWPYLQLYKLNIRI TNRVFRVRSLSLLPIKSTTRPGYGNCTYFKLC PHICVTGVYQSPWLISIRDKRPHEEKNILYFI GWSPDEQIRQNPLVSLCHETACFINRSLATN KTHAGYSESHCVQSFERNKLTCTVFYELTA KPWAEMRVQSLLFQVDFL | 2 | 119 |
| NC_025410 | 6799-8869 | gb:NC_025410:6799-8869\|Organism:Tuhoko virus 1\|Strain Name:UNKNOWN-NC_025410\|Protein Name:hemagglutinin-neuraminidase\|Gene Symbol:HN | MDSRSDSFTDIPLDNRIERTVTSKKTWRSIFR VTAIILLIICVVVSSISLNQHNDAPLNGAGNQ ATSGFMDAIKSLEKLMSQTINELNQVVMTTS VQLPNRITKFGQDILDQVTQMVRQCNAVCR GPGVGPSIQNYVIQGHAPTVSFDPISAEYQKF VFGITEKTLITAYHNPWECLRFPSQHLFDTT WCVSYQILTQNCSDHGPRITVIQLGEIMIANN LSTVFRDPVIKYIRHHIWLRSCSVVAYYSQC TIFCTSTNKSEPSDYADTGYEQLFLATLQSD GTFTEHSMHGVNIVHQWNAIYGGVGNGVII GRNMLIPLYGGINYYDHNTTIVQTVDLRPYP IPDSCSQTDNYQTNYLPSMFTNSYYGTNLVV SGYLSCRLMAGTPTSCSIRVIPIENMTMGSEG QFYLINNQLYYYKRSSNWIRDTQVYLLSYSD KGNIIEITSAERYIFKSVTSPDEGDCVTNHGC PSNCIGGLFQAPWILNDFKLCGSNITCPKIVT VWADQPDKRSNPMLSIAETDKLLLHKSYIN YHTAVGYSTVLCFDSPKLNLKTCVVLQELM SDDKLLIRISYSIVSIMVE | 2 | 120 |
| NC_028249 | 7059-9010 | gb:NC_028249:7059-9010\|Organism:Phocine distemper virus\|Strain Name:PDV/Wadden_Sea.NLD/1988\|Protein Name:hemagglutinin protein\|Gene Symbol:H | MFSHQDKVGAFYKNNARANSSKLSLVTDEV EERRSPWFLSILLILLVGILILLAITGIRFHQVV KSNLEFNKLLIEDMEKTKAVHHQVKDVLTP LFKIIGDEVGLRLPQKLNEIKQFIVQKTNFFN PNREFDFRELHWCINPPSKVKVNFTQYCEIT EFKEATRSVANSILLLTLYRGRDDIFPPYKCR GATTSMGNVFPLAVSLSMSLISKPSEVINML TAISEGIYGKTYLLVTDDTEENFETPEIRVFEI GFINRWLGDMPLFQTTNYRIISNNSNTKICTI AVGELALASLCTKESTILLNLGDEESQNSVL VVILGLFGATHMDQLEEVIPVAHPSIEKIHIT NHRGFIKDSVATWMVPALALSEQGEQINCL RSACKRRTYPMCNQTSWEPFGDKRLPSYGR LTLSLDVSTDLSINVSVAQGPIIFNGDGMDY YEGTLLNSGWLTIPPKNGTILGLINQASKGD QFIVTPHILTFAPRESSTDCHLPIQTYQIQDDD VLLESNLVVLPTQSFEYVVATYDVSRSDHAI VYYVYDPARTVSYTYPFRLRTKGRPDILRIE CFVWDGHLWCHQFYRFQLDATNSTSVVEN LIRIRFSCDRLDP | 2 | 121 |
| NC_028362 | 6951-8675 | gb:NC_028362:6951-8675\|Organism:Caprine parainfluenza virus 3\|Strain Name:JS2013\| | MEYWGHTNNPDKINRKVGVDQVRDRSKTL KIITFIISMMTSIMSTVALILILIMFIQNNNNNR IILQELRDETDAIEARIQKASNDIGVSIQSGIN TRLLTIQNHVQNYIPLALTQQVSSLRESINDV ITKREETQSKMPIQRMTHDDGIEPLIPDNFW KCPSGIPTISASPKIRLIPGPGLLATSTTINGCI | 2 | 122 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Protein Name:hemagglutinin-neuraminidase\| Gene Symbol:HN | RLPSLVINNLIYAYTSNLITQGCQDIGKSYQV LQIGIIITINSDLVPDLNPRITHTFDIDDNRKSC SLALRNADVYQLCSTPKVDERSDYSSIGIEDI VLDIVTSEGTVSTTRFTNNNITFDKPYAALYP SVGPGIYYDNKIIFLGYGGLEHEENGDVICNI TGCPGKTQHDCNQASYSPWFSNRRMVNAII LVNKGLNKVPSLQVWTIPMRQNYWGSEGR LLLLGNKIYIYTRSTSWHSKLQLGTLDISNYN DIRIRWTHHDVLSRPGSEECPWGNTCPRGCI TGVYNDAYPLNPSGSVVSSVILDSRTSRENPI ITYSTDTSRVNELAIRNNTLSAAYTTTNCVT HYGKGYCFHIIEINHKSLNTLQPMLFKTEIPK SCN | | |
| AB548428 | 5999-7261 | gb:AB548428:5999-7261\| Organism:Avian metapneumovirus\| Strain Name:VC0360616\| Protein Name:attachment glycoprotein\| Gene Symbol:G | MGSELYIIEGVSSSEIVLKQVLRRSKKILLGL VLSALGLTLTSTIVISICISVEQVKLRQCVDTY WAENGSLHPGQSTENTSTRGKTTTKDPRRL QATGAGKFESCGYVQVVDGDMHDRSYAVL GGVDCLGLLALCESGPICQGDTWSEDGNFC RCTFSSHGVSCCKKPKSKATTAQRNSKPANS KSTPPVHSDRASKEHNPSQGEQPRRGPTSSK TTIASTPSTEDTAKPTISKPKLTIRPSQRGPSG STKAASSTPSHKTNTRGTSKTTDQRPRTGPT PERPRQTHSTATPPPTTPIHKGRAPTPKPTTD LKVNPREGSTSPTAIQKNPTTQSNLVDCTLS DPDEPQRICYQVGTYNPSQSGTCNIEVPKCS TYGHACMATLYDTPFNCWRRTRRCICDSGG ELIEWCCTSQ | 1 | 123 |
| AF079780 | 8118-10115 | gb:AF079780\| Organism:Tupaia paramyxovirus\| Strain Name:UNKNOWN-AF079780\| Protein Name:hemagglutinin\| Gene Symbol:H | MDYHSHTTQTGSNETLYQDPLQSQSGSRDT LDGPPSTLQHYSNPPPYSEEDQGIDGPQRSQP LSTPHQYDRYYGVNIQHTRVYNHLGTIYKG LKLAFQILGWVSVIITMIITVTTLKKMSDGNS QDSAMLKSLDENFDAIQEVANLLDNEVRPK LGVTMTQTTFQLPKELSEIKRYLLRLERNCP VCGTEATPQGSKGNASGDTAFCPPCLTRQCS EDSTHDQGPGVEGTSRNHKGKINFPHILQSD DCGRSDNLIVYSINLVPGLSFIQLPSGTKHCII DVSYTFSDTLAGYLIVGGVDGCQLHNKAIIY LSLGYYKTKMIYPPDYIAIATYTYDLVPNLR DCSIAVNQTSLAAICTSKKTKENQDFSTSGV HPFYIFTLNTDGIFTVTVIEQSQLKLDYQYAA LYPATGPGIFIGDHLVFLMWGGLMTKAEGD AYCQASGCNDAHRTSCNIAQMPSAYGHRQL VNGLLMLPIKELGSHLIQPSLETISPKINWAG GHGRLYYNWEINTTYIYIEGKTWRSRPNLGII SWSKPLSIRWIDHSVARRPGARPCDSANDCP EDCLVGGYYDMFPMSSDYKTAITIIPTHHQW PSSPALKLFNTNREVRVVMILRPPNNVKKTT ISCIRIMQTNWCLGFIIFKEGNNAWGQIYSYI YQVESTCPNTK | 1 | 124 |
| AY590688 | 6138-7935 | gb:AY590688:6138-7935\| Organism:Avian metapneumovirus\| Strain Name:Colorado\| Protein Name:attachment glycoprotein\| Gene Symbol:G | MEVKVENVGKSQELKVKVKNFIKRSDCKK KLFALILGLVSFELTMNIMLSVMYVESNEAL SLCRIQGTPAPRDNKTNTENATKETTLHTTT TTRDPEVRETKTTKPQANEGATNPSRNLTTK GDKHQTTRATTEAELEKQSKQTTEPGTSTQ KHTPTRPSSKSPTTTQAIAQLTTPTTPKASTA PKNRQATTKKTETDTTTASRARNTNNPTET ATTTPKATTETGKSKEGPTQHTTKEQPETTA GETTTPQPRRTASRPAPTTKIEEEAETTKTRT TKSTQTSTGPPRPTGGAPSGAATEGSGRAAA AGGPSAASAGGRRRTEAAAERDRRTRAGAG PTAGGARARTAAASERGADTAGSAGGGPG GDGATGGLSGGAPAEREDASGGTAAAGPG DGTEADGRAPPAAALAGRTTESAAGAAGDS GRAGTAGWGSAADGRSTGGNAAAEAGAA QSGRAAPRQPSGGTAPESTAPPNSGGSGRAD | | |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | | AAPTEEVGVGSGLWRGRYVCGPCGESVPEH PMNPCFGDGTAWICSDDGGSLPAGCYDGGT DGVVCCGVCGGNSCCCGRVECTCGGGAGL LSCCCGSYSWS | | |
| EU403085 | 6620-8593 | gb:EU403085:6620-8593\|Organism:Avian paramyxovirus 3\|Strain Name:APMV3/PKT/Netherland/449/75\|Protein Name:hemagglutinin-neuraminidase protein\|Gene Symbol:HN | MESPPSGKDAPAFREPKRTCRLCYRATTLSL NLTIVVLSIISIYVSTQTGANNSCVNPTIVTPD YLTGSTTGSVEDLADLESQLREIRRDTGINLP VQIDNTENLILTTLASINSNLRFLQNATTESQ TCLSPVNDPRFVAGINRIPAGSMAYNDFSNLI EHVNFIPSPTTLSGCTRIPSFSLSKTHWCYTH NVISNGCLDHAASSQYISIGIVDTGLNNEPYF RTMSSKSLNDGLNRKSCSVTAAANACWLLC SVVTEYEAADYRSRTPTAMVLGRFDFNGEY TEIAVPSSLFDGRFASNYPGVGSGTQVNGTL YFPLYGGVLNGSDIETANKGKSFRPQNPKNR CPDSEAIQSFRAQDSYYPTRFGKVLIQQAIIA CRISNKSCTDFYLLYFDNNRVMMGAEARLY YLNNQLYLYQRSSSWWPHPLFYSISLPSCQA LAVCQITEAHLTLTYATSRPGMSICTGASRC PNNCVDGVYTDVWPLTKNDAQDPNLFYTV YLNNSTRRISPTISLYTYDRRIKSKLAVGSDI GAAYTTSTCFGRSDTGAVYCLTIMETVNTIF GQYRIVPILLRVTSR | 1 | 126 |
| FJ977568 | 6139-7936 | gb:FJ977568:6139-7936\|Organism:Avian metapneumovirus\|Strain Name:aMPV/MN/turkey/2a/97\|Protein Name:attachment glycoprotein\|Gene Symbol:G | MEVKVENVGKSQELKVKVKNFIKRSDCKK KLFALILGLVSFELTMNIMLSVMYVESNEAL SLCRIQGTPAPRDNKTNTENATKETTLHTTT TTRDPEVRETKTTKPQANEGATNPSRNLTTK GDKHQTTRATTEAELEKQSKQTTEPGTSTQ KHTPARPSSKSPTTTQATAQPTTPTAPKAST APKNRQATTKKTETDTTTASRARNTNNPTE TATTTPKATTETGKGKEGPTQHTTKEQPETT ARETTTPQPRRTASRPAPTTKIEEEAETTKTR TTKNTQTSTGPPRPTRSTPSKTATENNKRTTT TKRPNTASTDSRQQTRTTAEQDQQTQTRAK PTTNGAHPQTTTTPEHNTDTTNSTKGSPKED KTTRDPSSKTPTEQEDASKGTAAANPGGSAE ADRRAPPATTPTGRTTESAAGTTGDDSGAET TRRRSAADRRPTGGSTAAEAGTAQSGRATP KQPSGGTAAGNTAPPNNESSGRADAAPAEE AGVGPSIRRGRHACGPRRESAPEHPTNPCPG DGTAWTRSDGGGNLPAGRHDSGADGAARR GARGGNPRRRGRAERTRGGGAGPPSCRCGS HNRS | 1 | 127 |
| HG934339 | 5997-7166 | gb:HG934339:5997-7166\|Organism:Avian metapneumovirus type D\|Strain Name:Turkey/1985/Fr85.1\|Protein Name:attachment glycoprotein\|Gene Symbol:G | MGAKLYAISGASDAQLMKKTCAKLLEKVV PIIILAVLGITGTTTIALSISISIERAVLSDCTTQ LRNGTTSGSLSNPTRSTTSTAVTTRDIRGLQT TRTRELKSCSNVQIAYGYLHDSSNPVLDSIG CLGLLALCESGPFCQRNYNPRDRPKCRCTLR GKDISCCKEPPTAVTTSKTTPWGTEVHPTYP TQVTPQSQPATMAHQTATANQRSSTTEPVG SQGNTTSSNPEQQTEPPPSPQHPPTTTSQDQS TETADGQEHTPTRKTPTATSNRRSPTPKRQE TGRATPRNTATTQSGSSPPHSSPPGVDANME GQCKELQAPKPNSVCKGLDIYREALPRGCD KVLPLCKTSTIMCVDAYYSKPPICFGYNQRC FCMETFGPIEFCCKS | 1 | 128 |
| JN032116 | 4659-5252 | gb:JN032116:4659-5252\|Organism:Respiratory syncytial virus\|Strain Name:B/WI/629-12/06-07\|Protein | MSKNKNQRTARTLEKTWDTLNHLIVISSCLY KLNLKSIAQIALSVLAMIISTSLIIAAIIFIISAN HKVTLTTVTVQTIKNHTEKNITTYLTQVSPE RVSPSKQPTTTPPIHTNSATISPNTKSEIHHTT AQTKGRTSTPTQNNKPNTKPRPKNPPKKDD YHFEVFNFVPCSICGNNQLCKSICKTIPSNKP RKNQP | 1 | 129 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Name:attachment glycoprotein\| Gene Symbol:G | | | |
| KX258200 | 6254-7996 | gb:KX258200:6254-7996\| Organism:Avian paramyxovirus 14\|Strain Name:APMV14/duck/Japan/11OG0352/2011\|Protein Name:hemagglutinin-neuraminidase protein\|Gene Symbol:HN | MEGSRTVIYQGDPNEKNTWRLVFRTLTLILN LAILSVTIASIIITSKITLSEVTTLKTEGVEEVIT PLMATLSDSVQQEKMIYKEVAISIPLVLDKIQ TDVGTSVAQITDALRQIQGVNGTQAFALSN APEYSGGIEVPLFQIDSFVNKSMSISGLLEHA SFIPSPTTLHGCTRIPSFHLGPRHWCYTHNIIG SRCRDEGFSSMYISIGAITVNRDGNPLFITTAS TILADDNNRKSCSIIASSYGCDLLCSIVTESEN DDYANPNPTKMVHGRFLYNGSYVEQALPNS LFQDKWVAQYPGVGSGITTHGKVLFPIYGGI KKNTQLFYELSKYGFFAHNKELECKNMTEE QIRDIKAAYLPSKTSGNLFAQGIIYCNISKLG DCNVAVLNTSTTMMGAEGRLQMMGEYVY YYQRSSSWWPVGIVYKKSLAELMNGINMEV LSFEPIPLSKFPRPTWTAGLCQKPSICPDVCV TGVYTDLFSVTIGSTTDKDTYFGVYLDSATE RKDPWVAAADQYEWRNRVRLFESTTEAAY TTSTCFKNTVNNRVFCVSIVELRENLLGDWK IVPLLFQIGVSQGPPPK | 1 | 130 |
| KX940961 | 7978-12504 | gb:KX940961:7978-12504\| Organism:Beilong virus\|Strain Name:ERN081008_1S\| Protein Name:attachment glycoprotein\| Gene Symbol:G | MSQLAAHNLAMSNFYGTHQGDLSGSQKGE EQQVQGVIRYVSMIVGLLSLFTIIALNVTNIIY MTESGGTMQSIKTAQGSIDGSMREISGVIME DVKPKTDLINSMVSYNIPAQLSMIHQIIKNDV LKQCTPSFMFNNTICPLAENPTHSRYFEEVN LDSISECSGPDMHLGLGVNPEFIEFPSFAPGS TKPGSCVRLPSFSLSTTVFAYTHTIMGHGCSE LDVGDHYFSVGRIADAGHEIPQFETISSWFIN DKINRRSCTVAAGAMEAWMGCVIMTETFY DDLNSLDTGKLTISYLDVFGRKKEWIYTRSE ILYDYTYTSVYFSVGSGVVVGDTVYFLIWGS LSSPIEETAYCFAPDCSNYNQRMCNEAQRPS KFGHRQMVNGILKFKTTSTGKPLLSVGTLSP SVVPFGSEGRLMYSEITKIIYLYLRSTSWHAL PLTGLFVLGPPTSISWIVQRAVSRPGEFPCGA SNRCPKDCVTGVYTDLFPLGSRYEYAATVY LNSETYRVNPTLALINQTNIIASKKVTTESQR AGYTTTTCFVFKLRVWCISVVELAPSTMTA YEPIPFLYQLDLTCKGKNGSLAMRFTGKEGT YKSGRYKSPRNECFFEKVSNKYYFIVSTPEGI QPYEIRDLTPDRMPHIIMYISDVCAPALSAFK KLLPAMRPITTLTIGNWQFRPVEVSGGLRVSI GRNLTKEGDLTMSAPEDPGSNTFPGGHIPGN GLFDAGYYTVEYPKEWKQTTPKPSEGGNIID KNKTPVIPSRDNPTSDSSIPHRESIEPVRPTRE VLKSSDYVTIVSTDSGSGSGDFATGVPWTGV SPKAPQNGINLPGTELPHPTVLDRINTPAPSD PKVSADSDHTRDTIDPTALSKPLNHDTTGDT DTRINTGTATYGFTPGREATSSGKLANDLTN STSVPSEAHPSASTSEASKPEKNTDNRVTQD PTSGTAERPTTNAPVDGKHSTQLTDARPNTA DPERTSQHSSSTTRDEVKPSLPSTTEASTHQR TEAATPPELVNNTLNPPSTQVRSVRSLMQDA IAQAWNFVRGVTP | 1 | 131 |
| KY511044 | 6454-8310 | gb:KY511044:6454-8310\| Organism:Avian paramyxovirus UPO216\|Strain Name:APMV-15/WB/Kr/UPO216/2014\| | MERGISEVALANDRTEEKNTWRLIFRITVLV VSVITLGLTAASLVYSMNAAQPADFDGIIPA VQQVGTSLTNSIGGMQDVLDRTYKQVALES PLTLLNMESTIMNAITSLSYKINNGGNSSGCG APIHDPEYIGGIGKELLIDDNVDVTSFYPSAF KEHLNFIPAPTTGAGCTRIPSFDLSATHYCYT HNVILSGCQDHSHSHQYIALGVLKLSDTGNV FFSTLRSINLDDTANRKSCSISATPLGCDILCS | 1 | 132 |

TABLE 2-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | Sequence | #Sequences/ Cluster | SEQ ID NO |
|---|---|---|---|---|---|
| | | Protein Name:hemagglutinin-neuraminidase protein\|Gene Symbol:HN | KVTETELEDYKSEEPTPMVHGRLSFDGTYSE KDLDVNNLFSDWTANYPSVGGGSYIGNRV WYAVYGGLKPGSNTDQSQRDKYVIYKRYN NTCPDPEDYQINKAKSSYTPSYFGSKRVQQA ILSIAVSPTLGSDPVLTPLSNDVVLMGAEGR VMHIGGYTYLYQRGTSYYSPALLYPLNIQD KSATASSPYKFDAFTRPGSVPCQADARCPQS CVTGVYTDPYPLIFAKDHSIRGVYGMMLND VTARLNPIAAVFSNISRSQITRVSSSSTKAAY TTSTCFKVIKTNRIYCMSIAEISNTLFGEFRIV PLLVEILSNGGNTARSAGGTPVKESPKGWSD AIAEPLFCTPTNVTRYNADIRRYAYSWP | | |
| NC_025360 | 8127-10158 | gb:NC_025360:8127-10158\|Organism:Atlantic salmon paramyxovirus\|Strain Name:ASPV/Yrkje371/95\|Protein Name:hemagglutinin-neuraminidase protein\|Gene Symbol:HN | MPPAPSPVHDPSSFYGSSLFNEDTASRKGTSE EIHLLGIRWNTVLIVLGLILAIIGIGIGASSFSA =SGITGNTTKEIRLIVEEMSYGLVRISDSVRQEI SPKVTLLQNAVLSSIPALVTTETNTIINAVKN HCNSPPTPPPPTEAPLKKHETGMAPLDPTTY WTCTSGTPRFYSSPNATFIPGPSPLPHTATPG GCVRIPSMHIGSEIYAYTSNLIASGCQDIGKS YQNVQIGVLDRTPEGNPEMSPMLSHTFPIND NRKSCSIVTLKRAAYIYCSQPKVTEFVDYQT PGIEPMSLDHINANGTTKTWIYSPTEVVTDV PYASMYPSVGSGVVIDGKLVFLVYGGLLNGI QVPAMCLSPECPGIDQAACNASQYNQYLSG RQVVNGIATVDLMNGQKPHISVETISPSKNW FGAEGRLVYMGGRLYIYIRSTGWHSPIQIGVI YTMNPLAITWVTNTVLSRPGSAGCDWNNRC PKACLSGVYTDAYPISPDYNHLATMILHSTS TRSNPVMVYSSPTNMVNYAQLTTTAQIAGY TTTSCFTDNEVGYCATALELTPGTLSSVQPIL VMTKIPKECV | 1 | 133 |

ii) Lipid Fusogens

In some embodiments, the fusosome may be treated with fusogenic lipids, such as saturated fatty acids. In some embodiments, the saturated fatty acids have between 10-14 carbons. In some embodiments, the saturated fatty acids have longer-chain carboxylic acids. In some embodiments, the saturated fatty acids are mono-esters.

In some embodiments, the fusosome may be treated with unsaturated fatty acids. In some embodiments, the unsaturated fatty acids have between C16 and C18 unsaturated fatty acids. In some embodiments, the unsaturated fatty acids include oleic acid, glycerol mono-oleate, glycerides, diacylglycerol, modified unsaturated fatty acids, and any combination thereof.

Without wishing to be bound by theory, in some embodiments negative curvature lipids promote membrane fusion. In some embodiments, the fusosome comprises one or more negative curvature lipids, e.g., negative curvature lipids that are exogenous relative to the source cell, in the membrane. In embodiments, the negative curvature lipid or a precursor thereof is added to media comprising source cells or fusosomes. In embodiments, the source cell is engineered to express or overexpress one or more lipid synthesis genes. The negative curvature lipid can be, e.g., diacylglycerol (DAG), cholesterol, phosphatidic acid (PA), phosphatidylethanolamine (PE), or fatty acid (FA).

Without wishing to be bound by theory, in some embodiments positive curvature lipids inhibit membrane fusion. In some embodiments, the fusosome comprises reduced levels of one or more positive curvature lipids, e.g., exogenous positive curvature lipids, in the membrane. In embodiments, the levels are reduced by inhibiting synthesis of the lipid, e.g., by knockout or knockdown of a lipid synthesis gene, in the source cell. The positive curvature lipid can be, e.g., lysophosphatidylcholine (LPC), phosphatidylinositol (PtdIns), lysophosphatidic acid (LPA), lysophosphatidylethanolamine (LPE), or monoacylglycerol (MAG).

iii) Chemical Fusogens

In some embodiments, the fusosome may be treated with fusogenic chemicals. In some embodiments, the fusogenic chemical is polyethylene glycol (PEG) or derivatives thereof.

In some embodiments, the chemical fusogen induces a local dehydration between the two membranes that leads to unfavorable molecular packing of the bilayer. In some embodiments, the chemical fusogen induces dehydration of an area near the lipid bilayer, causing displacement of aqueous molecules between cells and allowing interaction between the two membranes together.

In some embodiments, the chemical fusogen is a positive cation. Some nonlimiting examples of positive cations include Ca2+, Mg2+, Mn2+, Zn2+, La3+, Sr3+, and H+.

In some embodiments, the chemical fusogen binds to the target membrane by modifying surface polarity, which alters the hydration-dependent intermembrane repulsion.

In some embodiments, the chemical fusogen is a soluble lipid soluble. Some nonlimiting examples include oleoylglycerol, dioleoylglycerol, trioleoylglycerol, and variants and derivatives thereof.

In some embodiments, the chemical fusogen is a water-soluble chemical. Some nonlimiting examples include polyethylene glycol, dimethyl sulphoxide, and variants and derivatives thereof.

In some embodiments, the chemical fusogen is a small organic molecule. A nonlimiting example includes n-hexyl bromide.

In some embodiments, the chemical fusogen does not alter the constitution, cell viability, or the ion transport properties of the fusogen or target membrane.

In some embodiments, the chemical fusogen is a hormone or a vitamin. Some nonlimiting examples include abscisic acid, retinol (vitamin A1), a tocopherol (vitamin E), and variants and derivatives thereof.

In some embodiments, the fusosome comprises actin and an agent that stabilizes polymerized actin. Without wishing to be bound by theory, stabilized actin in a fusosome can promote fusion with a target cell. In embodiments, the agent that stabilizes polymerized actin is chosen from actin, myosin, biotin-streptavidin, ATP, neuronal Wiskott-Aldrich syndrome protein (N-WASP), or formin. See, e.g., Langmuir. 2011 Aug. 16; 27 (16): 10061-71 and Wen et al., Nat Commun. 2016 Aug. 31; 7. In embodiments, the fusosome comprises actin that is exogenous or overexpressed relative to the source cell, e.g., wild-type actin or actin comprising a mutation that promotes polymerization. In embodiments, the fusosome comprises ATP or phosphocreatine, e.g., exogenous ATP or phosphocreatine.

iv) Small Molecule Fusogens

In some embodiments, the fusosome may be treated with fusogenic small molecules. Some nonlimiting examples include halothane, nonsteroidal anti-inflammatory drugs (NSAIDs) such as meloxicam, piroxicam, tenoxicam, and chlorpromazine.

In some embodiments, the small molecule fusogen may be present in micelle-like aggregates or free of aggregates.

v) Fusogen Modifications

In some embodiments, the fusogen is linked to a cleavable protein. In some cases, a cleavable protein may be cleaved by exposure to a protease. An engineered fusion protein may bind any domain of a transmembrane protein. The engineered fusion protein may be linked by a cleavage peptide to a protein domain located within the intermembrane space. The cleavage peptide may be cleaved by one or a combination of intermembrane proteases (e.g. HTRA2/OMI which requires a non-polar aliphatic amino acid—valine, isoleucine or methionine are preferred—at position P1, and hydrophilic residues—arginine is preferred—at the P2 and P3 positions).

In some embodiments the fusogen is linked to an affinity tag. In some embodiments the affinity tag aids in fusosome separation and isolation. In some embodiments the affinity tag is cleavable. In some embodiments the affinity tag is non-covalently linked to the fusogen. In some embodiments the affinity tag is present on the fusosome and separate from the fusogen.

In some embodiments, fusogen proteins are engineered by any methods known in the art or any method described herein to comprise a proteolytic degradation sequence, e.g., a mitochondrial or cytosolic degradation sequence. Fusogen proteins may be engineered to include, but is not limited to a proteolytic degradation sequence, e.g., a Caspase 2 protein sequence (e.g., Val-Asp-Val-Ala-Asp-|-(SEQ ID NO: 134)) or other proteolytic sequences (see, for example, Gasteiger et al., The Proteomics Protocols Handbook; 2005:571-607), a modified proteolytic degradation sequence that has at least 75%, 80%, 85%, 90%, 95% or greater identity to the wildtype proteolytic degradation sequence, a cytosolic proteolytic degradation sequence, e.g., ubiquitin, or a modified cytosolic proteolytic degradation sequence that has at least 75%, 80%, 85%, 90%, 95% or greater identity to the wildtype proteolytic degradation sequence. In some embodiments, a composition comprises mitochondria in a source cell or chondrisome comprising a protein modified with a proteolytic degradation sequence, e.g., at least 75%, 80%, 85%, 90%, 95% or greater identity to the wildtype proteolytic degradation sequence, a cytosolic proteolytic degradation sequence, e.g., ubiquitin, or a modified cytosolic proteolytic degradation sequence that has at least 75%, 80%, 85%, 90%, 95% or greater identity to the wildtype proteolytic degradation sequence.

In some embodiments, the fusogen may be modified with a protease domain that recognizes specific proteins, e.g., over-expression of a protease, e.g., an engineered fusion protein with protease activity. For example, a protease or protease domain from a protease, such as MMP, mitochondrial processing peptidase, mitochondrial intermediate peptidase, inner membrane peptidase.

See, Alfonzo, J. D. & Soll, D. Mitochondrial tRNA import—the challenge to understand has just begun. Biological Chemistry 390:717-722. 2009; Langer, T. et al. Characterization of Peptides Released from Mitochondria. THE JOURNAL OF BIOLOGICAL CHEMISTRY. Vol. 280, No. 4. 2691-2699, 2005; Vliegh, P. et al. Synthetic therapeutic peptides: science and market. Drug Discovery Today. 15 (1/2). 2010; Quiros P. M. m et al., New roles for mitochondrial proteases in health, ageing and disease. Nature Reviews Molecular Cell Biology. V16, 2015; Weber-Lotfi, F. et al. DNA import competence and mitochondrial genetics. Biopolymers and Cell. Vol. 30. N 1. 71-73, 2014.

III. Positive Target Cell-Specific Regulatory Element

In some embodiments, a a fusosome described herein, e.g. a virus, e.g., a retrovirus, contains a nucleic acid (e.g., the gene encoding the exogenous agent), e.g. retroviral nucleic acid that comprises a positive target cell-specific regulatory element such as a tissue-specific promoter, a tissue-specific enhancer, a tissue-specific splice site, a tissue-specific site extending half-life of an RNA or protein, a tissue-specific mRNA nuclear export promoting site, a tissue-specific translational enhancing site, or a tissue-specific post-translational modification site.

In some embodiments, a fusosome, e.g. virus, e.g. retrovirus, described herein contains a nucleic acid, e.g. a retroviral nucleic acid that can comprise regions, e.g., non-translated regions such as origins of replication, selection cassettes, promoters, enhancers, translation initiation signals (Shine Dalgarno sequence or Kozak sequence), introns, a polyadenylation sequence, 5' and 3' untranslated regions-which interact with host cellular proteins to carry out transcription and translation, and which are capable of directing, increasing, regulating, or controlling the transcription or expression of an operatively linked polynucleotide. Such elements may vary in their strength and specificity. Depending on the vector system and host utilized, any number of suitable transcription and translation elements, including ubiquitous promoters and inducible promoters may be used.

In particular embodiments, control elements are capable of directing, increasing, regulating, or controlling the transcription or expression of an operatively linked polynucleotide in a cell-specific manner. In particular embodiments, retroviral nucleic acids comprise one or more expression control sequences that are specific to particular cells, cell types, or cell lineages e.g., target cells; that is, expression of polynucleotides operatively linked to an expression control sequence specific to particular cells, cell types, or cell lineages is expressed in target cells and not (or at a lower level) in non-target cells.

In particular embodiments, a retroviral nucleic acid can include exogenous, endogenous, or heterologous control sequences such as promoters and/or enhancers.

In embodiments, the promoter comprises a recognition site to which an RNA polymerase binds. An RNA polymerase initiates and transcribes polynucleotides operably linked to the promoter. In particular embodiments, promoters operative in mammalian cells comprise an AT-rich region located approximately 25 to 30 bases upstream from the site where transcription is initiated and/or another sequence found 70 to 80 bases upstream from the start of transcription, a CNCAAT region where N may be any nucleotide.

In embodiments, an enhancer comprises a segment of DNA which contains sequences capable of providing enhanced transcription and in some instances can function independent of orientation relative to another control sequence. An enhancer can function cooperatively or additively with promoters and/or other enhancer elements. In some embodiments, a promoter/enhancer segment of DNA contains sequences capable of providing both promoter and enhancer functions.

Illustrative ubiquitous expression control sequences include, but are not limited to, a cytomegalovirus (CMV) immediate early promoter, a viral simian virus 40 (SV40) (e.g., early or late), a Moloney murine leukemia virus (MoMLV) LTR promoter, a Rous sarcoma virus (RSV) LTR, a herpes simplex virus (HSV) (thymidine kinase) promoter, H5, P7.5, and P11 promoters from vaccinia virus, an elongation factor 1-alpha (EF1a) promoter, early growth response 1 (EGR1), ferritin H (FerH), ferritin L (FerL), Glyceraldehyde 3-phosphate dehydrogenase (GAPDH), eukaryotic translation initiation factor 4A1 (EIF4A1), heat shock 70 kDa protein 5 (HSPA5), heat shock protein 90 kDa beta, member 1 (HSP90B1), heat shock protein 70 kDa (HSP70), β-kinesin (β-KIN), the human ROSA 26 locus Orions et al., Nature Biotechnology 25, 1477-1482 (2007)), a Ubiquitin C promoter (UBC), a phosphoglycerate kinase-1 (PGK) promoter, a cytomegalovirus enhancer/chicken β-actin (CAG) promoter, a β-actin promoter and a myeloproliferative sarcoma virus enhancer, negative control region deleted, d1587rev primer-binding site substituted (MND) promoter (Challita et al., J Virol. 69 (2): 748-55 (1995)).

In some embodiments, a promoter may be paired with a heterologous gene to impart the regulatory functions of that promoter on the heterologous gene. In some embodiments, the cis-regulatory elements from a first gene's promoter may be linked to segments of a different gene's promoter to create chimeric promoters that have properties of both promoters.

In some embodiments, the promoter is a tissue-specific promoter, e.g., a promoter that drives expression in a T cell, e.g., a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell. Various suitable T cell-specific promoters are described in Table 3 below. In some embodiments, a fusosome (e.g., viral vector) described herein comprises, in its nucleic acid, a promoter having a sequence of a promoter in Table 3, or transcriptionally active fragment thereof, or a variant having at least 70%, 75%, 80%, 85%, 90%, 95%, 96%, 97%, 98%, or 99% identity thereto. In some embodiments, a fusosome (e.g., viral vector) described herein comprises, in its nucleic acid, a promoter having transcription factor binding sites from the region within 3 kb of the transcriptional start site for the genes listed in Table 3. In some embodiments, a fusosome (e.g., viral vector) described herein comprises, in its nucleic acid, a region within 2.5 kb, 2 kb, 1.5 kb, 1 kb, or 0.5 kb immediately upstream of the transcriptional start site of a gene listed in Table 3, or a transcriptionally active fragment thereof, or a variant having at least 70%, 75%, 80%, 85%, 90%, 95%, 96%, 97%, 98%, or 99% identity thereto.

TABLE 3

Exemplary promoters, e.g., T cell-specific promoters

| Target cell type | Exemplary promoters |
|---|---|
| Treg | IL2RA (CD25), LRRC32, FOXP3, IKZF2 |
| T cell | CD3δ, CD2, Tyrosine-protein kinase Lck, ICOS, CD28, TCF7, TCR Vβ 8.1 |
| CD8+ T cells | CD8, GZMB |
| CD4+ T cells | CD4 |
| Th17 cells | Nuclear receptor ROR-gamma, IL-17 |

In some embodiments, the T cell-specific promoter is a promoter described in Immgen consortium, herein incorporated by reference in its entirety, e.g., the T cell-specific promoter is an IL2RA (CD25), LRRC32, FOXP3, or IKZF2 promoter. In some embodiments, the T cell-specific promoter or enhancer is a promoter or enhancer described in Schmidl et al., Blood. 2014 Apr. 24; 123 (17): e68-78., herein incorporated by reference in its entirety. In some embodiments, the T cell-specific promoter is a transcriptionally active fragment of any of the foregoing. In some embodiments, the T-cell specific promoter is a variant having at least 70%, 75%, 80%, 85%, 90%, 95%, 96%, 97%, 98%, or 99% identity to any of the foregoing.

An internal ribosome entry site (IRES) typically promotes direct internal ribosome entry to the initiation codon, such as ATG, of a cistron (a protein encoding region), thereby leading to the cap-independent translation of the gene. See, e.g., Jackson et al, (1990) Trends Biochem Sci 15 (12): 477-83) and Jackson and Kaminski. (1995) RNA 1 (10): 985-1000. In particular embodiments, a vector includes one or more exogenous genes encoding one or more exogenous agents. In particular embodiments, to achieve efficient translation of each of the plurality of exogenous protein agents, the polynucleotide sequences can be separated by one or more IRES sequences or polynucleotide sequences encoding self-cleaving polypeptides.

The retroviral nucleic acids herein can also comprise one or more Kozak sequences, e.g., a short nucleotide sequence that facilitates the initial binding of mRNA to the small subunit of the ribosome and increases translation. The consensus Kozak sequence is (GCC) RCCATGG, where R is a purine (A or G) (Kozak, (1986) Cell. 44 (2): 283-92, and Kozak, (1987) Nucleic Acids Res. 15 (20): 8125-48).

Promoters Responsive to a Heterologous Transcription Factor and Inducer

In some embodiments, a retroviral nucleic acid comprises an element allowing for conditional expression of the exogenous agent, e.g., any type of conditional expression including, but not limited to, inducible expression; repressible expression; cell type-specific expression, or tissue-specific expression. In some embodiments, to achieve conditional expression of the exogenous agent, expression is controlled by subjecting a cell, tissue, or organism to a treatment or condition that causes the exogenous agent to be expressed or that causes an increase or decrease in expression of the exogenous agent.

Illustrative examples of inducible promoters/systems include, but are not limited to, steroid-inducible promoters such as promoters for genes encoding glucocorticoid or estrogen receptors (inducible by treatment with the corresponding hormone), metallothionine promoter (inducible by treatment with various heavy metals), MX-1 promoter (inducible by interferon), the "GeneSwitch" mifepristone-regulatable system (Sirin et al., 2003, *Gene,* 323:67), the cumate inducible gene switch (WO 2002/088346), tetracycline-dependent regulatory systems, etc.

Transgene expression may be activated or repressed by the presence or absence of an inducer molecule. In some cases the inducer molecule activates or represses gene expression in a graded manner, and in some cases the inducer molecules activates or represses gene expression in an all-or-nothing manner.

A commonly used inducible promoter/system is tetracycline (Tet)-regulated system. The Tet system is based on the coexpression of two elements in the respective target cell: (i) the tetracycline response element containing repeats of the Tet-operator sequences (TetO) fused to a minimal promoter and connected to a gene of interest (e.g., a gene encoding the exogenous agent) and (ii) the transcriptional transactivator ((TA), a fusion protein of the Tet-repressor (TetR) and the transactivation domain of the herpes simplex virus derived VP16 protein. Whereas in the originally described version, transgene expression was active in the absence of tetracycline or its potent analogue doxycycline (Do), referred to as Tet-OFF system, modification of four amino acids within the transactivator protein resulted in a reverse tTA (rtTA), which only binds to TetO in the presence of Dox (Tet-ON system). In some embodiments, in the transactivator, the VP16 domain has been replaced by minimal activation domains, potential splice-donor and splice acceptor sites have been removed, and the protein has been codon optimization, resulting in the improved Transactivator variant rtTA2S-M2 with higher sensitivity to Dox and lower baseline activity. Furthermore, different Tet-responsive promoter elements have been generated, including modification in the TetO with 36-nucleotide spacing from neighboring operators to enhance regulation. Additional modifications may be useful to further reduce basal activity and increase the expression dynamic range. As an example, the pTet-T11 (short: TII) variant displays a high dynamic range and low background activity.

Conditional expression can also be achieved by using a site specific DNA recombinase. According to certain embodiments, the retroviral nucleic acid comprises at least one (typically two) site(s) for recombination mediated by a site specific recombinase, e.g., an excisive or integrative protein, enzyme, cofactor or associated protein that is involved in recombination reactions involving one or more recombination sites (e.g., two, three, four, five, seven, ten, twelve, fifteen, twenty, thirty, fifty, etc.), which may be wild-type proteins (see Landy, Current Opinion in Biotechnology 3:699-707 (1993)), or mutants, derivatives (e.g., fusion proteins containing the recombination protein sequences or fragments thereof), fragments, and variants thereof. Illustrative examples of recombinases include, but are not limited to: Cre, Int, IHF, Xis, Flp, Fis, Hin, Gin, ΦC31, Cin, Tn3 resolvase, TndX, XerC, XerD, TnpX, Hjc, Gin, SpCCE1, and ParA.

Riboswitches to Regulate Exogenous Agent Expression

Some of the compositions and methods provided herein include one or more riboswitches or polynucleotides that include one or more riboswitch. Riboswitches are a common feature in bacteria to regulate gene expression and are a means to achieve RNA control of biological functions. Riboswitches can be present in the 5'-untranslated region of mRNAs and can allow for regulatory control over gene expression through binding of a small molecule ligand that induces or suppresses a riboswitch activity. In some embodiments, the riboswitch controls a gene product involved in the generation of the small molecule ligand. Riboswitches typically act in a cis-fashion, although riboswitches have been identified that act in a trans-fashion. Natural riboswitches consist of two domains: an aptamer domain that binds the ligand through a three-dimensional folded RNA structure and a function switching domain that induces or suppresses an activity in the riboswitch based on the absence or presence of the ligand. Thus, there are two ligand sensitive conformations achieved by the riboswitch, representing on and off states (Garst et al., 2011). The function switching domain can affect the expression of a polynucleotide by regulating: an internal ribosome entry site, pre-mRNA splice donor accessibility in the retroviral gene construct, translation, termination of transcription, transcript degradation, miRNA expression, or shRNA expression (Dambach and Winkler 2009). The aptamer and function switching domains can be used as modular components allowing for synthetic RNA devices to control gene expression either as native aptamers, mutated/evolved native aptamers, or totally synthetic aptamers that are identified from screening random RNA libraries (McKeague et al 2016).

The purine riboswitch family represents one of the largest families with over 500 sequences found (Mandal et al 2003; US20080269258; and WO2006055351). The purine riboswitches share a similar structure consisting of three conserved helical elements/stem structures (PI, P2, P3) with intervening loop/junction elements (J1-2, L2, J2-3, L3, J3-1). The aptamer domains of the purine family of riboswitches naturally vary in their affinity/regulation by various purine compounds such as adenine, guanine, adenosine, guanosine, deoxyadenosine, deoxyguanosine, etc. due to sequence variation (Kim et al. 2007)

In some embodiments, a retroviral nucleic acid described herein comprises a polynucleotide encoding the exogenous agent operably linked to a promoter and a riboswitch. The riboswitch include one or more of, e.g., all of: a.) an aptamer domain, e.g., an aptamer domain capable of binding a nucleoside analogue antiviral drug and having reduced binding to guanine or 2'-deoxyguanosine relative to the nucleoside analogue antiviral drug; and b.) a function switching domain, e.g., a function switching domain capable of regulating expression of the exogenous agent, wherein binding of the nucleoside analogue by the aptamer domain induces or suppresses the expression regulating activity of the function switching domain, thereby regulating expression of the exogenous agent. In some embodiments, the exogenous agent can be a polypeptide, an miRNA, or an shRNA. For example, in an embodiment, the riboswitch is operably linked to a nucleic acid encoding a chimeric antigen receptor (CAR). In non-limiting illustrative examples provided herein, the exogenous gene encodes one or more engineered signaling polypeptides. For instance, the riboswitch and the target polynucleotide encoding one or more engineered signaling polypeptides can be found in the genome of a source cell, in a replication incompetent recombinant retroviral particle, in a T cell and/or in an NK cell.

The aptamer domains can be used, e.g., as modular components and combined with any of the function switching domains to affect the RNA transcript. In any of the embodiments disclosed herein, the riboswitch can affect the RNA transcript by regulating any of the following activities: internal ribosomal entry site (IRES), pre-mRNA splice donor accessibility, translation, termination of transcription, transcript degradation, miRNA expression, or shRNA expression. In some embodiments, the function switching domain can control binding of an anti-IRES to an IRES (see, e.g. Ogawa, RNA (2011), 17:478-488, the disclosure of which is incorporated by reference herein in its entirety). In any of the embodiments disclosed herein, the presence or absence of the small molecule ligand can cause the riboswitch to affect the RNA transcript. In some embodiments, the riboswitch can include a ribozyme. Riboswitches with ribozymes can inhibit or enhance transcript degradation of target polynucleotides in the presence of the small molecule ligand. In some embodiments, the ribozyme can be a pistol class of ribozyme, a hammerhead class of ribozyme, a twisted class of ribozyme, a hatchet class of ribozyme, or the HDV (hepatitis delta virus).

IV. Non-Target Cell-Specific Regulatory Element

In some embodiments, the non-target cell specific regulatory element or negative TCSRE comprises a tissue-specific miRNA recognition sequence, tissue-specific protease recognition site, tissue-specific ubiquitin ligase site, tissue-specific transcriptional repression site, or tissue-specific epigenetic repression site.

In some embodiments, a non-target cell comprises an endogenous miRNA. The retroviral nucleic acid (e.g., the gene encoding the exogenous agent) may comprise a recognition sequence for that miRNA. Thus, if the retroviral nucleic acid enters the non-target cell, the miRNA can downregulate expression of the exogenous agent. This helps achieve additional specificity for the target cell versus non-target cells.

In some embodiments, the miRNA is a small non-coding RNAs of 20-22 nucleotides, typically excised from ~70 nucleotide foldback RNA precursor structures known as pre-miRNAs. In general, miRNAs negatively regulate their targets in one of two ways depending on the degree of complementarity between the miRNA and the target. First, miRNAs that bind with perfect or nearly perfect complementarity to protein-coding mRNA sequences typically induce the RNA-mediated interference (RNAi) pathway. miRNAs that exert their regulatory effects by binding to imperfect complementary sites within the 3' untranslated regions (UTRs) of their mRNA targets, typically repress target-gene expression post-transcriptionally, apparently at the level of translation, through a RISC complex that is similar to, or possibly identical with, the one that is used for the RNAi pathway. Consistent with translational control, miRNAs that use this mechanism reduce the protein levels of their target genes, but the mRNA levels of these genes are only minimally affected. miRNAs (e.g., naturally occurring miRNAs or artificially designed miRNAs) can specifically target any mRNA sequence. For example, in one embodiment, the skilled artisan can design short hairpin RNA constructs expressed as human miRNA (e.g., miR-30 or miR-21) primary transcripts. This design adds a Drosha processing site to the hairpin construct and has been shown to greatly increase knockdown efficiency (Pusch et al., 2004). The hairpin stem consists of 22-nt of dsRNA (e.g., antisense has perfect complementarity to desired target) and a 15-19-nt loop from a human miR. Adding the miR loop and miR30 flanking sequences on either or both sides of the hairpin results in greater than 10-fold increase in Drosha and Dicer processing of the expressed hairpins when compared with conventional shRNA designs without microRNA. Increased Drosha and Dicer processing translates into greater siRNA/miRNA production and greater potency for expressed hairpins.

Hundreds of distinct miRNA genes are differentially expressed during development and across tissue types. Several studies have suggested important regulatory roles for miRNAs in a broad range of biological processes including developmental timing, cellular differentiation, proliferation, apoptosis, oncogenesis, insulin secretion, and cholesterol biosynthesis. (See Bartel 2004 Cell 116:281-97; Ambros 2004 Nature 431:350-55; Du et al. 2005 Development 132:4645-52; Chen 2005 N. Engl. J. Med. 353:1768-71; Krutzfeldt et al. 2005 Nature 438:685-89.) Molecular analysis has shown that miRNAs have distinct expression profiles in different tissues. Computational methods have been used to analyze the expression of approximately 7,000 predicted human miRNA targets. The data suggest that miRNA expression broadly contributes to tissue specificity of mRNA expression in many human tissues. (See Sood et al. 2006 PNAS USA 103 (8): 2746-51.)

Thus, an miRNA-based approach may be used for restricting expression of the exogenous agent to a target cell population by silencing exogenous agent expression in non-target cell types by using endogenous microRNA species. MicroRNA induces sequence-specific post-transcriptional gene silencing in many organisms, either by inhibiting translation of messenger RNA (mRNA) or by causing degradation of the mRNA. See, e.g., Brown et al. 2006 Nature Med. 12 (5): 585-91., and WO2007/000668, each of which is herein incorporated by reference in its entirety. In some embodiments, the retroviral nucleic acid comprises one or more of (e.g., a plurality of) tissue-specific miRNA recognition sequences. In some embodiments, the tissue-specific miRNA recognition sequence is about 20-25, 21-24, or 23 nucleotides in length. In embodiments, the tissue-specific miRNA recognition sequence has perfect complementarity to an miRNA present in a non-target cell. In some embodiments, the exogenous agent does not comprise GFP, e.g., does not comprise a fluorescent protein, e.g., does not comprise a reporter protein. In some embodiments, the off-target cells are not hematopoietic cell and/or the miRNA is not present in hematopoietic cells.

In some embodiments, a method herein comprises tissue-specific expression of an exogenous agent in a target cell comprising contacting a plurality of retroviral vectors comprising a nucleotide encoding the exogenous agent and at least one tissue-specific microRNA (miRNA) target sequence with a plurality of cells comprising target cells and non-target cells, wherein the exogenous agent is preferentially expressed in, e.g., restricted, to the target cell.

For example, the retroviral nucleic acid can comprise at least one miRNA recognition sequence operably linked to a nucleotide sequence having a corresponding miRNA in a non-target cell, e.g., a hematopoietic progenitor cell (HSPC), hematopoietic stem cell (HSC), which prevents or reduces expression of the nucleotide sequence in the non-target cell but not in a target cell, e.g., differentiated cell. In some embodiments, the retroviral nucleic acid comprises at least one miRNA sequence target for a miRNA which is present in an effective amount (e.g., concentration of the endogenous miRNA is sufficient to reduce or prevent expression of a transgene) in the non-target cell, and comprises a transgene. In embodiments, the miRNA used in this system is strongly expressed in non-target cells, such as HSPC and HSC, but not in differentiated progeny of e.g. the myeloid and lymphoid lineage, preventing or reducing expression of a transgene in sensitive stem cell populations, while maintaining expression and therapeutic efficacy in the target cells.

In some embodiments, the negative TSCRE or NTSCRE comprises an miRNA recognition site. Exemplary miRNAs are provided in Table 4 below. In some embodiments, the nucleic acid (e.g., fusosome nucleic acid or retroviral nucleic acid) comprises a sequence that is complementary to a miRNA of Table 4, or has at least 50%, 60%, 70%, 75%, 80%, 85%, 90%, 95%, 96%, 97%, 98%, or 99% complementarity thereto. In some embodiments, the nucleic acid (e.g., fusosome nucleic acid or retroviral nucleic acid) comprises a sequence that is perfectly complementary to a seed sequence within an endogenous miRNA, e.g., miRNA of Table 4. In embodiments, the seed sequence is at least 6, 7, 8, 9, or 10 nucleotides in length.

TABLE 4

Exemplary miRNAs.

| Target cell type | miRNA name and silenced cell type (non-target cell type) |
|---|---|
| Treg | miR31, miR363, or miR29c (for de-targeting from conventional CD4+ T cells) |

In some embodiments, the negative TSCRE or NTSCRE comprises an miRNA recognition site for an miRNA described herein. Exemplary miRNAs include those found in Smigielska-Czepiel et al., Genes Immun. 2014 March; 15 (2): 115-25, herein incorporated by reference in its entirety, e.g., miR31, miR363, or miR29c.

In some embodiments, a fusosome described herein comprises a nucleic acid comprising a payload gene and a positive target cell-specific regulatory element, e.g., wherein the target cell is a Treg cell, e.g., a thymus-derived regulatory T cell, a peripherally derived regulatory T cell, a CD4+Foxp3+ regulatory T cell, or a CD4+FoxP3− type 1 regulatory T (Tr1) cell. In some embodiments, the nucleic acid further comprises a non-target cell-specific regulatory element (NTCSRE), e.g., wherein the NTSCRE comprises an miRNA recognition site for an miRNA expressed in a non-Treg cell, e.g., a conventional CD4+ T cell.

In some embodiments, the negative TSCRE or NTSCRE comprises an miRNA recognition site for an miRNA described herein. Exemplary miRNAs include those found in Griffiths-Jones et al. Nucleic Acids Res. 2006 Jan. 1, 34; Chen and Lodish, Semin Immunol. 2005 April; 17 (2): 155-65; Chen et al. Science. 2004 Jan. 2; 303 (5654): 83-6; Barad et al. Genome Res. 2004 December; 14 (12): 2486-2494; Krichevsky et al., RNA. 2003 October; 9 (10): 1274-81; Kasashima et al. Biochem Biophys Res Commun. 2004 Sep. 17; 322 (2): 403-10; Houbaviy et al., Dev Cell. 2003 August; 5 (2): 351-8; Lagos-Quintana et al., Curr Biol. 2002 Apr. 30; 12 (9): 735-9; Calin et al., Proc Natl Acad Sci USA. 2004 Mar. 2; 101 (9): 2999-3004; Sempere et al. Genome Biol. 2004; 5 (3): R13; Metzler et al., Genes Chromosomes Cancer. 2004 February; 39 (2): 167-9; Calin et al., Proc Natl Acad Sci USA. 2002 Nov. 26; 99 (24): 15524-9; Mansfield et al. Nat Genet. 2004 October; 36 (10): 1079-83; Michael et al. Mol Cancer Res. 2003 October; 1 (12): 882-91; and at miRNA.org.

In some embodiments, the negative TSCRE or NTSCRE comprises an miRNA recognition site for an miRNA selected from miR-1b, miR-189b, miR-93, miR-125b, miR-130, miR-32, miR-128, miR-22, miR124a, miR-296, miR-143, miR-15, miR-141, miR-143, miR-16, miR-127, miR99a, miR-183, miR-19b, miR-92, miR-9, miR-130b, miR-21, miR-30b, miR-16, miR-142-s, miR-99a, miR-212, miR-30c, miR-213, miR-20, miR-155, miR-152, miR-139, miR-30b, miR-7, miR-30c, miR-18, miR-137, miR-219, miR-1d, miR-178, miR-24, miR-122a, miR-215, miR-142-a, miR-223, miR-142, miR-124a, miR-190, miR-149, miR-193, miR-181, let-7a, miR-132, miR-27a, miR-9*, miR-200b, miR-266, miR-153, miR-135, miR-206, miR-24, miR-19a, miR-199, miR-26a, miR-194, miR-125a, miR-15a, miR-145, miR-133, miR-96, miR-131, miR-124b, miR-151, miR-7b, miR-103, and miR-208.

In some embodiments, the nucleic acid (e.g., retroviral nucleic acid) comprises two or more miRNA recognition sites. In some embodiments, the first miRNA recognition site and second miRNA recognition site are recognized by the same miRNA, and in some embodiments, the first miRNA recognition site and second miRNA recognition site are recognized by different miRNAs. In some embodiments, the first miRNA recognition site and second miRNA recognition site are recognized by miRNAs present in the same non-target cell, and in some embodiments, the first miRNA recognition site and second miRNA recognition site are recognized by miRNAs present in different non-target cells. In some embodiments, one or both of the first miRNA recognition site and second miRNA recognition site are recognized by miRNAs of Table 4. In some embodiments, one or more of the miRNA recognition sites on the fusosome nucleic acid (e.g. retroviral nucleic acid) are transcribed in cis with the exogenous agent. In some embodiments, one or more of the miRNA recognition sites on the fusosome nucleic acid (e.g., retroviral nucleic acid) are situated downstream of the poly A tail sequence, e.g., between the poly A tail sequence and the WPRE. In some embodiments, one or more of the miRNA recognition sites on the fusosome nucleic acid (e.g., retroviral nucleic acid) are situated downstream of the WPRE.

V. Immune Modulation

In some embodiments, a fusosome, e.g. a retroviral vector or VLP described herein comprises elevated CD47. See, e.g., U.S. Pat. No. 9,050,269, which is herein incorporated by reference in its entirety. In some embodiments, a fusosome, e.g. a retroviral vector or VLP described herein comprises elevated Complement Regulatory protein. See, e.g., ES2627445T3 and U.S. Pat. No. 6,790,641, each of which is incorporated herein by reference in its entirety. In some embodiments, a fusosome, e.g. a retroviral vector or VLP described herein lacks or comprises reduced levels of an MHC protein, e.g., an MHC-1 class 1 or class II. See, e.g., US20170165348, which is herein incorporated by reference in its entirety.

Sometimes fusosome, e.g. retroviral vectors or VLPs are recognized by the subject's immune system. In the case of enveloped viral vector particles (e.g., retroviral vector particles), membrane-bound proteins that are displayed on the surface of the viral envelope may be recognized and the viral particle itself may be neutralised. Furthermore, on infecting a target cell, the viral envelope becomes integrated with the cell membrane and as a result viral envelope proteins may become displayed on or remain in close association with the surface of the cell. The immune system may therefore also target the cells which the viral vector particles have infected. Both effects may lead to a reduction in the efficacy of exogenous agent delivery by viral vectors.

A viral particle envelope typically originates in a membrane of the source cell. Therefore, membrane proteins that are expressed on the cell membrane from which the viral particle buds may be incorporated into the viral envelope.

The Immune Modulating Protein CD47

The internalization of extracellular material into cells is commonly performed by a process called endocytosis (Rabinovitch, 1995, Trends Cell Biol. 5 (3): 85-7; Silverstein, 1995, Trends Cell Biol. 5 (3): 141-2; Swanson et al., 1995, Trends Cell Biol. 5 (3): 89-93; Allen et al., 1996, J. Exp. Med. 184 (2): 627-37). Endocytosis may fall into two general categories: phagocytosis, which involves the uptake of particles, and pinocytosis, which involves the uptake of fluid and solutes.

Professional phagocytes have been shown to differentiate from non-self and self, based on studies with knockout mice lacking the membrane receptor CD47 (Oldenborg et al., 2000, Science 288 (5473): 2051-4). CD47 is a ubiquitous member of the Ig superfamily that interacts with the immune inhibitory receptor SIRPα (signal regulatory protein) found on macrophages (Fujioka et al., 1996, Mol. Cell. Biol. 16 (12): 6887-99; Veillette et al., 1998, J. Biol. Chem. 273 (35): 22719-28; Jiang et al., 1999, J. Biol. Chem. 274 (2): 559-62). Although CD47-SIRPα interactions appear to deactivate autologous macrophages in mouse, severe reductions of CD47 (perhaps 90%) are found on human blood cells from some Rh genotypes that show little to no evidence of anemia (Mouro-Chanteloup et al., 2003, Blood 101 (1): 338-344) and also little to no evidence of enhanced cell interactions with phagocytic monocytes (Arndt et al., 2004, Br. J. Haematol. 125 (3): 412-4).

In some embodiments, a retroviral vector or VLP (e.g., a viral particle having a radius of less than about 1 μm, 400 nm, or 150 nm), comprises at least a biologically active portion of CD47, e.g., on an exposed surface of the retroviral vector or VLP. In some embodiments, the retroviral vector (e.g., lentivirus) or VLP includes a lipid coat. In embodiments, the amount of the biologically active CD47 in the retroviral vector or VLP is between about 20-250, 20-50, 50-100, 100-150, 150-200, or 200-250 molecules/$\mu m^2$. In some embodiments, the CD47 is human CD47.

A method described herein can comprise evading phagocytosis of a particle by a phagocytic cell. The method may include expressing at least one peptide including at least a biologically active portion of CD47 in a retroviral vector or VLP so that, when the retroviral vector or VLP comprising the CD47 is exposed to a phagocytic cell, the viral particle evades phacocytosis by the phagocytic cell, or shows decreased phagocytosis compared to an otherwise similar unmodified retroviral vector or VLP. In some embodiments, the half-life of the retroviral vector or VLP in a subject is extended compared to an otherwise similar unmodified retroviral vector or VLP.

MHC Deletion

The major histocompatibility complex class I (MHC-I) is a host cell membrane protein that can be incorporated into viral envelopes and, because it is highly polymorphic in nature, it is a major target of the body's immune response (McDevitt H. O. (2000) *Annu. Rev. Immunol.* 18:1-17). MHC-I molecules exposed on the plasma membrane of source cells can be incorporated in the viral particle envelope during the process of vector budding. These MHC-I molecules derived from the source cells and incorporated in the viral particles can in turn be transferred to the plasma membrane of target cells. Alternatively, the MHC-I molecules may remain in close association with the target cell membrane as a result of the tendency of viral particles to absorb and remain bound to the target cell membrane.

The presence of exogenous MHC-I molecules on or close to the plasma membrane of transduced cells may elicit an alloreactive immune response in subjects. This may lead to immune-mediated killing or phagocytosis of transduced cells either upon ex vivo gene transfer followed by administration of the transduced cells to the subject, or upon direct in vivo administration of the viral particles. Furthermore, in the case of in vivo administration of MHC-I bearing viral particles into the bloodstream, the viral particles may be neutralised by pre-existing MHC-I specific antibodies before reaching their target cells.

Accordingly, in some embodiments, a source cell is modified (e.g., genetically engineered) to decrease expression of MHC-I on the surface of the cell. In embodiments, the source comprises a genetically engineered disruption of a gene encoding β2-microglobulin (B2M). In embodiments, the source cell comprises a genetically engineered disruption of one or more genes encoding an MHC-I a chain. The cell may comprise genetically engineered disruptions in all copies of the gene encoding β2-microglobulin. The cell may comprise genetically engineered disruptions in all copies of the genes encoding an MHC-I a chain. The cell may comprise both genetically engineered disruptions of genes encoding β2-microglobulin and genetically engineered disruptions of genes encoding an MHC-I a chain. In some embodiments, the retroviral vector or VLP comprises a decreased number of surface-exposed MHC-I molecules. The number of surface-exposed MHC-I molecules may be decreased such that the immune response to the MHC-I is decreased to a therapeutically relevant degree. In some embodiments, the enveloped viral vector particle is substantially devoid of surface-exposed MHC-I molecules.

HLA-G/E Overexpression

In some embodiments, a retroviral vector or VLP displays on its envelope a tolerogenic protein, e.g., an ILT-2 or ILT-4 agonist, e.g., HLA-E or HLA-G or any other ILT-2 or ILT-4 agonist. In some embodiments, a retroviral vector or VLP has increased expression of HLA-E, HLA-G, ILT-2 or ILT-4 compared to a reference retrovirus, e.g., an unmodified retrovirus otherwise similar to the retrovirus.

In some embodiments, a retrovirus composition has decreased MHC Class I compared to an unmodified retrovirus and increased HLA-G compared to an unmodified retrovirus.

In some embodiments, the retroviral vector or VLP has an increase in expression of HLA-G or HLA-E, e.g., an increase in expression of 1%, 5%, 10%, 20%, 30%, 40%, 50%, 60%, 70%, 80%, 90%, or more of HLA-G or HLA-E, compared to a reference retrovirus, e.g., an unmodified retrovirus otherwise similar to the retrovirus, wherein expression of HLA-G or HLA-E is assayed in vitro using flow cytometry, e.g., FACS.

In some embodiments, the retrovirus with increased HLA-G expression demonstrates reduced immunogenicity, e.g., as measured by reduced immune cell infiltration, in a teratoma formation assay.

Complement Regulatory Proteins

Complement activity is normally controlled by a number of complement regulatory proteins (CRPs). These proteins prevent spurious inflammation and host tissue damage. One group of proteins, including CD55/decay accelerating factor (DAF) and CD46/membrane cofactor protein (MCP), inhibits the classical and alternative pathway C3/C5 convertase enzymes. Another set of proteins including CD59 regulates MAC assembly. CRPs have been used to prevent rejection of xenotransplanted tissues and have also been shown to protect viruses and viral vectors from complement inactivation.

Membrane resident complement control factors include, e.g., decay-accelerating factor (DAF) or CD55, factor H (FH)-like protein-1 (FHL-1), C4b-binding protein (C4BP), Complement receptor 1 (CD35), membrane cofactor protein (MCP) or CD46, and CD59 (protectin) (e.g., to prevent the formation of membrane attack complex (MAC) and protect cells from lysis).

Albumin Binding Protein

In some embodiments the lentivirus binds albumin. In some embodiments the lentivirus comprises on its surface a protein that binds albumin. In some embodiments the lentivirus comprises on its surface an albumin binding protein. In some embodiments the albumin binding protein is streptococcal Albumin Binding protein. In some embodiments the albumin binding protein is streptococcal Albumin Binding Domain.

Expression of Non-Fusogen Proteins on the Lentiviral Envelope

In some embodiments the lentivirus is engineered to comprise one or more proteins on its surface. In some embodiments the proteins affect immune interactions with a subject. In some embodiments the proteins affect the pharmacology of the lentivirus in the subject. In some embodiments the protein is a receptor. In some embodiments the protein is an agonist. In some embodiments the protein is a signaling molecule. In some embodiments, the protein on the lentiviral surface comprises OKT3 or IL7.

In some embodiments, comprises a mitogenic transmembrane protein and/or a cytokine-based transmembrane protein is present in the source cell, which can be incorporated into the retrovirus when it buds from the source cell membrane. The mitogenic transmembrane protein and/or a cytokine-based transmembrane protein can be expressed as a separate cell surface molecule on the source cell rather than being part of the viral envelope glycoprotein.

Exemplary Features

In some embodiments of any of the aspects described herein, the retroviral vector, VLP, or pharmaceutical composition is substantially non-immunogenic. Immunogenicity can be quantified, e.g., as described herein.

In some embodiments, a retroviral vector or VLP fuses with a target cell to produce a recipient cell. In some embodiments, a recipient cell that has fused to one or more retroviral vectors or VLPs is assessed for immunogenicity. In embodiments, a recipient cell is analyzed for the presence of antibodies on the cell surface, e.g., by staining with an anti-IgM antibody. In other embodiments, immunogenicity is assessed by a PBMC cell lysis assay. In embodiments, a recipient cell is incubated with peripheral blood mononuclear cells (PBMCs) and then assessed for lysis of the cells by the PBMCs. In other embodiments, immunogenicity is assessed by a natural killer (NK) cell lysis assay. In embodiments, a recipient cell is incubated with NK cells and then assessed for lysis of the cells by the NK cells. In other embodiments, immunogenicity is assessed by a CD8+ T-cell lysis assay. In embodiments, a recipient cell is incubated with CD8+ T-cells and then assessed for lysis of the cells by the CD8+ T-cells.

In some embodiments, the retroviral vector or VLP comprises elevated levels of an immunosuppressive agent (e.g., immunosuppressive protein) as compared to a reference retroviral vector or VLP, e.g., one produced from an unmodified source cell otherwise similar to the source cell, or a HEK293 cell. In some embodiments, the elevated level is at least 5%, 10%, 20%, 30%, 40%, 50%, 60%, 70%, 80%, 90%, 2-fold, 3-fold, 5-fold, 10-fold, 20-fold, 50-fold, or 100-fold. In some embodiments, the retroviral vector or VLP comprises an immunosuppressive agent that is absent from the reference cell. In some embodiments, the retroviral vector or VLP comprises reduced levels of an immunostimulatory agent (e.g., immunostimulatory protein) as compared to a reference retroviral vector or VLP, e.g., one produced from an unmodified source cell otherwise similar to the source cell, or a HEK293 cell. In some embodiments, the reduced level is at least 5%, 10%, 20%, 30%, 40%, 50%, 60%, 70%, 80%, 90%, 95%, 98%, or 99% compared to the reference retroviral vector or VLP. In some embodiments, the immunostimulatory agent is substantially absent from the retroviral vector or VLP.

In some embodiments, the retroviral vector or VLP, or the source cell from which the retroviral vector or VLP is derived, has one, two, three, four, five, six, seven, eight, nine, ten, eleven, twelve, or more of the following characteristics:

a. less than 50%, 40%, 30%, 20%, 15%, 10%, or 5% or lesser expression of MHC class I or MHC class II, compared to a reference retroviral vector or VLP, e.g., an unmodified retroviral vector or VLP from a source cell otherwise similar to the source cell, or a HeLa cell, or a HEK293 cell;
b. less than 50%, 40%, 30%, 20%, 15%, 10%, or 5% or lesser expression of one or more co-stimulatory proteins including but not limited to: LAG3, ICOS-L, ICOS, Ox40L, OX40, CD28, B7, CD30, CD30L 4-1BB, 4-1BBL, SLAM, CD27, CD70, HVEM, LIGHT, B7-H3, or B7-H4, compared to a reference retroviral vector or VLP, e.g., an unmodified retroviral vector or VLP from a cell otherwise similar to the source cell, or a HEK cell, or a reference cell described herein;
c. expression of surface proteins which suppress macrophage engulfment e.g., CD47, e.g., detectable expression by a method described herein, e.g., more than 1.5-fold, 2-fold, 3-fold, 4-fold, 5-fold, 10-fold, or more expression of the surface protein which suppresses macrophage engulfment, e.g., CD47, compared to a reference retroviral vector or VLP, e.g., an unmodified retroviral vector or VLP from a cell otherwise similar to the source cell, a Jurkat cell, or a HEK293 cell;
d. expression of soluble immunosuppressive cytokines, e.g., IL-10, e.g., detectable expression by a method described herein, e.g., more than 1.5-fold, 2-fold, 3-fold, 4-fold, 5-fold, 10-fold, or more expression of soluble immunosuppressive cytokines, e.g., IL-10, compared to a reference retroviral vector or VLP, e.g., an unmodified retroviral vector or VLP from a cell otherwise similar to the source cell, or a HEK293 cell;
e. expression of soluble immunosuppressive proteins, e.g., PD-L1, e.g., detectable expression by a method described herein, e.g., more than 1.5-fold, 2-fold, 3-fold, 4-fold, 5-fold, 10-fold, or more expression of soluble immunosuppressive proteins, e.g., PD-L1, compared to a reference retroviral vector or VLP, e.g., an unmodified retroviral vector or VLP from a cell otherwise similar to the source cell, or a HEK293 cell;

f. less than 50%, 40%, 30%, 20%, 15%, 10%, or 5% or lesser expression of soluble immune stimulating cytokines, e.g., IFN-gamma or TNF-α, compared to a reference retroviral vector or VLP, e.g., an unmodified retroviral vector or VLP from a cell otherwise similar to the source cell, or a HEK293 cell or a U-266 cell;
g. less than 50%, 40%, 30%, 20%, 15%, 10%, or 5% or lesser expression of endogenous immune-stimulatory antigen, e.g., Zg16 or Hormad1, compared to a reference retroviral vector or VLP, e.g., an unmodified retroviral vector or VLP from a cell otherwise similar to the source cell, or a HEK293 cell or an A549 cell, or a SK-BR-3 cell;
h. expression of, e.g., detectable expression by a method described herein, HLA-E or HLA-G, compared to a reference retroviral vector or VLP, e.g., an unmodified retroviral vector or VLP from a cell otherwise similar to the source cell, a HEK293 cell, or a or a Jurkat cell;
i. surface glycosylation profile, e.g., containing sialic acid, which acts to, e.g., suppress NK cell activation;
j. less than 50%, 40%, 30%, 20%, 15%, 10%, or 5% or lesser expression of TCRα/β, compared to a reference retroviral vector or VLP, e.g., an unmodified retroviral vector or VLP from a cell otherwise similar to the source cell, a HEK293 cell, or a Jurkat cell;
k. less than 50%, 40%, 30%, 20%, 15%, 10%, or 5% or lesser expression of ABO blood groups, compared to a reference retroviral vector or VLP, e.g., an unmodified retroviral vector or VLP from a cell otherwise similar to the source cell, a HEK293 cell, or a HeLa cell;
l. less than 50%, 40%, 30%, 20%, 15%, 10%, or 5% or lesser expression of Minor Histocompatibility Antigen (MHA), compared to a reference retroviral vector or VLP, e.g., an unmodified retroviral vector or VLP from a cell otherwise similar to the source cell, a HEK293 cell, or a Jurkat cell; or
m. has less than 10%, 9%, 8%, 7%, 6%, 5%, 4%, 3%, 2%, 1%, or less, of mitochondrial MHAs, compared to a reference retroviral vector or VLP e.g., an unmodified retroviral vector or VLP from a cell otherwise similar to the source cell, a HEK293 cell, or a Jurkat cell, or has no detectable mitochondrial MHAs.

In embodiments, the co-stimulatory protein is 4-1BB, B7, SLAM, LAG3, HVEM, or LIGHT, and the reference cell is HDLM-2. In some embodiments, the co-stimulatory protein is BY-H3 and the reference cell is HeLa. In some embodiments, the co-stimulatory protein is ICOSL or B7-H4, and the reference cell is SK-BR-3. In some embodiments, the co-stimulatory protein is ICOS or OX40, and the reference cell is MOLT-4. In some embodiments, the co-stimulatory protein is CD28, and the reference cell is U-266. In some embodiments, the co-stimulatory protein is CD30L or CD27, and the reference cell is Daudi.

In some embodiments, the retroviral vector, VLP, or pharmaceutical composition does not substantially elicit an immunogenic response by the immune system, e.g., innate immune system. In embodiments, an immunogenic response can be quantified, e.g., as described herein. In some embodiments, an immunogenic response by the innate immune system comprises a response by innate immune cells including, but not limited to NK cells, macrophages, neutrophils, basophils, eosinophils, dendritic cells, mast cells, or gamma/delta T cells. In some embodiments, an immunogenic response by the innate immune system comprises a response by the complement system which includes soluble blood components and membrane bound components.

In some embodiments, the retroviral vector, VLP, or pharmaceutical composition does not substantially elicit an immunogenic response by the immune system, e.g., adaptive immune system. In some embodiments, an immunogenic response by the adaptive immune system comprises an immunogenic response by an adaptive immune cell including, but not limited to a change, e.g., increase, in number or activity of T lymphocytes (e.g., CD4 T cells, CD8 T cells, and or gamma-delta T cells), or B lymphocytes. In some embodiments, an immunogenic response by the adaptive immune system includes increased levels of soluble blood components including, but not limited to a change, e.g., increase, in number or activity of cytokines or antibodies (e.g., IgG, IgM, IgE, IgA, or IgD).

In some embodiments, the retroviral vector, VLP, or pharmaceutical composition is modified to have reduced immunogenicity. In some embodiments, the retroviral vector, VLP, or pharmaceutical composition has an immunogenicity less than 5%, 10%, 20%, 30%, 40%, or 50% lesser than the immunogenicity of a reference retroviral vector or VLP, e.g., an unmodified retroviral vector or VLP from a cell otherwise similar to the source cell, a HEK293 cell, or a Jurkat cell.

In some embodiments of any of the aspects described herein, the retroviral vector, VLP, or pharmaceutical composition is derived from a source cell, e.g., a mammalian cell, having a modified genome, e.g., modified using a method described herein, to reduce, e.g., lessen, immunogenicity. Immunogenicity can be quantified, e.g., as described herein.

In some embodiments, the retroviral vector, VLP, or pharmaceutical composition is derived from a mammalian cell depleted of, e.g., with a knock out of, one, two, three, four, five, six, seven or more of the following:
a. MHC class I, MHC class II or MHA;
b. one or more co-stimulatory proteins including but not limited to: LAG3, ICOS-L, ICOS, Ox40L, OX40, CD28, B7, CD30, CD30L 4-1BB, 4-1BBL, SLAM, CD27, CD70, HVEM, LIGHT, B7-H3, or B7-H4;
c. soluble immune-stimulating cytokines e.g., IFN-gamma or TNF-α;
d. endogenous immune-stimulatory antigen, e.g., Zg16 or Hormad1;
e. T-cell receptors (TCR);
f. The genes encoding ABO blood groups, e.g., ABO gene;
g. transcription factors which drive immune activation, e.g., NFkB;
h. transcription factors that control MHC expression e.g., class II trans-activator (CIITA), regulatory factor of the Xbox 5 (RFX5), RFX-associated protein (RFXAP), or RFX ankyrin repeats (RFXANK; also known as RFXB); or
i. TAP proteins, e.g., TAP2, TAP1, or TAPBP, which reduce MHC class I expression.

In some embodiments, the retroviral vector or VLP is derived from a source cell with a genetic modification which results in increased expression of an immunosuppressive agent, e.g., one, two, three or more of the following (e.g., wherein before the genetic modification the cell did not express the factor):
a. surface proteins which suppress macrophage engulfment, e.g., CD47; e.g., increased expression of CD47 compared to a reference retroviral vector or VLP, e.g., an unmodified retroviral vector or VLP from a cell otherwise similar to the source cell, a HEK293 cell, or a Jurkat cell;

b. soluble immunosuppressive cytokines, e.g., IL-10, e.g., increased expression of IL-10 compared to a reference retroviral vector or VLP, e.g., an unmodified retroviral vector or VLP from a cell otherwise similar to the source cell, a HEK293 cell, or a Jurkat cell;
c. soluble immunosuppressive proteins, e.g., PD-1, PD-L1, CTLA4, or BTLA; e.g., increased expression of immunosuppressive proteins compared to a reference retroviral vector or VLP, e.g., an unmodified retroviral vector or VLP from a cell otherwise similar to the cell source, a HEK293 cell, or a Jurkat cell;
d. a tolerogenic protein, e.g., an ILT-2 or ILT-4 agonist, e.g., HLA-E or HLA-G or any other endogenous ILT-2 or ILT-4 agonist, e.g., increased expression of HLA-E, HLA-G, ILT-2 or ILT-4 compared to a reference retroviral vector or VLP, e.g., an unmodified retroviral vector or VLP from a cell otherwise similar to the source cell, a HEK293 cell, or a Jurkat cell; or
e. surface proteins which suppress complement activity, e.g., complement regulatory proteins, e.g. proteins that bind decay-accelerating factor (DAF, CD55), e.g. factor H (FH)-like protein-1 (FHL-1), e.g. C4b-binding protein (C4BP), e.g. complement receptor 1 (CD35), e.g. Membrane cofactor protein (MCP, CD46), eg. PROFECTIN™ (CD59), e.g. proteins that inhibit the classical and alternative complement pathway CD/C5 convertase enzymes, e.g. proteins that regulate MAC assembly; e.g. increased expression of a complement regulatory protein compared to a reference retroviral vector or VLP, e.g. an unmodified retroviral vector or VLP from a cell otherwise similar to the source cell, a HEK293 cell, or a Jurkat cell.

In some embodiments, the increased expression level is at least 5%, 10%, 20%, 30%, 40%, 50%, 60%, 70%, 80%, 90%, 2-fold, 3-fold, 5-fold, 10-fold, 20-fold, 50-fold, or 100-fold higher as compared to a reference retroviral vector or VLP.

In some embodiments, the retroviral vector or VLP is derived from a source cell modified to have decreased expression of an immunostimulatory agent, e.g., one, two, three, four, five, six, seven, eight or more of the following:

a. less than 50%, 40%, 30%, 20%, 15%, 10%, or 5% or lesser expression of MHC class I or MHC class II, compared to a reference retroviral vector or VLP, e.g., an unmodified retroviral vector or VLP from a cell otherwise similar to the source cell, a HEK293 cell, or a HeLa cell;
b. less than 50%, 40%, 30%, 20%, 15%, 10%, or 5% or lesser expression of one or more co-stimulatory proteins including but not limited to: LAG3, ICOS-L, ICOS, Ox40L, OX40, CD28, B7, CD30, CD30L 4-1BB, 4-1BBL, SLAM, CD27, CD70, HVEM, LIGHT, B7-H3, or B7-H4, compared to a reference retroviral vector or VLP, e.g., an unmodified retroviral vector or VLP from a cell otherwise similar to the source cell, a HEK293 cell, or a reference cell described herein;
c. less than 50%, 40%, 30%, 20%, 15%, 10%, or 5% or lesser expression of soluble immune stimulating cytokines, e.g., IFN-gamma or TNF-$\alpha$, compared to a reference retroviral vector or VLP, e.g., an unmodified retroviral vector or VLP from a cell otherwise similar to the source cell, a HEK293 cell, or a U-266 cell;
d. less than 50%, 40%, 30%, 20%, 15%, 10%, or 5% or lesser expression of endogenous immune-stimulatory antigen, e.g., Zg16 or Hormad1, compared to a reference retroviral vector or VLP, e.g., an unmodified retroviral vector or VLP from a cell otherwise similar to the source cell, a HEK293 cell, or an A549 cell or a SK-BR-3 cell;
e. less than 50%, 40%, 30%, 20%, 15%, 10%, or 5% or lesser expression of T-cell receptors (TCR) compared to a reference retroviral vector or VLP, e.g., an unmodified retroviral vector or VLP from a cell otherwise similar to the source cell, a HEK293 cell, or a Jurkat cell;
f. less than 50%, 40%, 30%, 20%, 15%, 10%, or 5% or lesser expression of ABO blood groups, compared to a reference retroviral vector or VLP, e.g., an unmodified retroviral vector or VLP from a cell otherwise similar to the source cell, a HEK293 cell, or a HeLa cell;
g. less than 50%, 40%, 30%, 20%, 15%, 10%, or 5% or lesser expression of transcription factors which drive immune activation, e.g., NFkB; compared to a reference retroviral vector or VLP, e.g., an unmodified retroviral vector or VLP from a cell otherwise similar to the source cell, a HEK293 cell, or a Jurkat cell
h. less than 50%, 40%, 30%, 20%, 15%, 10%, or 5% or lesser expression of transcription factors that control MHC expression, e.g., class II trans-activator (CIITA), regulatory factor of the Xbox 5 (RFX5), RFX-associated protein (RFXAP), or RFX ankyrin repeats (RFXANK; also known as RFXB) compared to a reference retroviral vector or VLP, e.g., an unmodified retroviral vector or VLP from a cell otherwise similar to the source cell, a HEK293 cell, or a Jurkat cell; or
i. less than 50%, 40%, 30%, 20%, 15%, 10%, or 5% or lesser expression of TAP proteins, e.g., TAP2, TAP1, or TAPBP, which reduce MHC class I expression compared to a reference retroviral vector or VLP, e.g., an unmodified retroviral vector or VLP from a cell otherwise similar to the source cell, a HEK293 cell, or a HeLa cell.

In some embodiments, a retroviral vector, VLP, or pharmaceutical composition derived from a mammalian cell, e.g., a HEK293, modified using shRNA expressing lentivirus to decrease MHC Class I expression, has lesser expression of MHC Class I compared to an unmodified retroviral vector or VLP, e.g., a retroviral vector or VLP from a cell (e.g., mesenchymal stem cell) that has not been modified. In some embodiments, a retroviral vector or VLP derived from a mammalian cell, e.g., a HEK293, modified using lentivirus expressing HLA-G to increase expression of HLA-G, has increased expression of HLA-G compared to an unmodified retroviral vector or VLP, e.g., from a cell (e.g., a HEK293) that has not been modified.

In some embodiments, the retroviral vector, VLP, or pharmaceutical composition is derived from a source cell, e.g., a mammalian cell, which is not substantially immunogenic, wherein the source cells stimulate, e.g., induce, T-cell IFN-gamma secretion, at a level of 0 pg/mL to >0 pg/mL, e.g., as assayed in vitro, by IFN-gamma ELISPOT assay.

In some embodiments, the retroviral vector, VLP, or pharmaceutical composition is derived from a source cell, e.g., a mammalian cell, wherein the mammalian cell is from a cell culture treated with an immunosuppressive agent, e.g., a glucocorticoid (e.g., dexamethasone), cytostatic (e.g., methotrexate), antibody (e.g., Muromonab-CD3), or immunophilin modulator (e.g., Ciclosporin or rapamycin).

In some embodiments, the retroviral vector, VLP, or pharmaceutical composition is derived from a source cell, e.g., a mammalian cell, wherein the mammalian cell comprises an exogenous agent, e.g., a therapeutic agent.

In some embodiments, the retroviral vector, VLP, or pharmaceutical composition is derived from a source cell, e.g., a mammalian cell, wherein the mammalian cell is a recombinant cell.

In some embodiments, the retroviral vector, VLP, or pharmaceutical is derived from a mammalian cell genetically modified to express viral immunoevasins, e.g., hCMV US2, or US11.

In some embodiments, the surface of the retroviral vector or VLP, or the surface of the source cell, is covalently or non-covalently modified with a polymer, e.g., a biocompatible polymer that reduces immunogenicity and immune-mediated clearance, e.g., PEG.

In some embodiments, the surface of the retroviral vector or VLP, or the surface of the source cell is covalently or non-covalently modified with a sialic acid, e.g., a sialic acid comprising glycopolymers, which contain NK-suppressive glycan epitopes.

In some embodiments, the surface of the retroviral vector or VLP, or the surface of the source cell is enzymatically treated, e.g., with glycosidase enzymes, e.g., α-N-acetylgalactosaminidases, to remove ABO blood groups In some embodiments, the surface of the retroviral vector or VLP, or the surface of the source cell is enzymatically treated, to give rise to, e.g., induce expression of, ABO blood groups which match the recipient's blood type.

Parameters for Assessing Immunogenicity

In some embodiments, the retroviral vector or VLP is derived from a source cell, e.g., a mammalian cell which is not substantially immunogenic, or modified, e.g., modified using a method described herein, to have a reduction in immunogenicity. Immunogenicity of the source cell and the retroviral vector or VLP can be determined by any of the assays described herein.

In some embodiments, the retroviral vector or VLP has an increase, e.g., an increase of 1%, 5%, 10%, 20%, 30%, 40%, 50%, 60%, 70%, 80%, 90%, or more, in in vivo graft survival compared to a reference retroviral vector or VLP, e.g., an unmodified retroviral vector or VLP from a cell otherwise similar to the source cell.

In some embodiments, the retroviral vector or VLP has a reduction in immunogenicity as measured by a reduction in humoral response following one or more implantation of the retroviral vector or VLP into an appropriate animal model, e.g., an animal model described herein, compared to a humoral response following one or more implantation of a reference retroviral vector or VLP, e.g., an unmodified retroviral vector or VLP from a cell otherwise similar to the source cell, into an appropriate animal model, e.g., an animal model described herein. In some embodiments, the reduction in humoral response is measured in a serum sample by an anti-cell antibody titre, e.g., anti-retroviral or anti-VLP antibody titre, e.g., by ELISA. In some embodiments, the serum sample from animals administered the retroviral vector or VLP has a reduction of 1%, 5%, 10%, 20%, 30%, 40%, 50%, 60%, 70%, 80%, 90%, or more of an anti-retroviral or anti-VLP antibody titer compared to the serum sample from animals administered an unmodified retroviral vector or VLP. In some embodiments, the serum sample from animals administered the retroviral vector or VLP has an increased anti-retroviral or anti-VLP antibody titre, e.g., increased by 1%, 2%, 5%, 10%, 20%, 30%, or 40% from baseline, e.g., wherein baseline refers to serum sample from the same animals before administration of the retroviral vector or VLP.

In some embodiments, the retroviral vector or VLP has a reduction in macrophage phagocytosis, e.g., a reduction of 1%, 5%, 10%, 20%, 30%, 40%, 50%, 60%, 70%, 80%, 90%, or more in macrophage phagocytosis compared to a reference retroviral vector or VLP, e.g., an unmodified retroviral vector or VLP from a cell otherwise similar to the source cell, wherein the reduction in macrophage phagocytosis is determined by assaying the phagocytosis index in vitro, e.g., as described in Example 8. In some embodiments, the retroviral vector or VLP has a phagocytosis index of 0, 1, 10, 100, or more, e.g., as measured by an assay of Example 8, when incubated with macrophages in an in vitro assay of macrophage phagocytosis.

In some embodiments, the source cell or recipient cell has a reduction in cytotoxicity mediated cell lysis by PBMCs, e.g., a reduction of 1%, 5%, 10%, 20%, 30%, 40%, 50%, 60%, 70%, 80%, 90%, or more in cell lysis compared to a reference cell, e.g., an unmodified cell otherwise similar to the source cell, or a recipient cell that received an unmodified retroviral vector or VLP, or a mesenchymal stem cells, e.g., using an assay of Example 17. In embodiments, the source cell expresses exogenous HLA-G.

In some embodiments, the source cell or recipient cell has a reduction in NK-mediated cell lysis, e.g., a reduction of 1%, 5%, 10%, 20%, 30%, 40%, 50%, 60%, 70%, 80%, 90%, or more in NK-mediated cell lysis compared to a reference cell, e.g., an unmodified cell otherwise similar to the source cell, or a recipient cell that received an unmodified retroviral vector or VLP, wherein NK-mediated cell lysis is assayed in vitro, by a chromium release assay or europium release assay, e.g., using an assay of Example 18.

In some embodiments, the source cell or recipient cell has a reduction in CD8+ T-cell mediated cell lysis, e.g., a reduction of 1%, 5%, 10%, 20%, 30%, 40%, 50%, 60%, 70%, 80%, 90%, or more in CD8 T cell mediated cell lysis compared to a reference cell, e.g., an unmodified cell otherwise similar to the source cell, or a recipient cell that received an unmodified retroviral vector or VLP, wherein CD8 T cell mediated cell lysis is assayed in vitro, by an assay of Example 19.

In some embodiments, the source cell or recipient cell has a reduction in CD4+ T-cell proliferation and/or activation, e.g., a reduction of 1%, 5%, 10%, 20%, 30%, 40%, 50%, 60%, 70%, 80%, 90%, or more compared to a reference cell, e.g., an unmodified cell otherwise similar to the source cell, or a recipient cell that received an unmodified retroviral vector or VLP, wherein CD4 T cell proliferation is assayed in vitro (e.g. co-culture assay of modified or unmodified mammalian source cell, and CD4+ T-cells with CD3/CD28 Dynabeads).

In some embodiments, the retroviral vector or VLP causes a reduction in T-cell IFN-gamma secretion, e.g., a reduction of 1%, 5%, 10%, 20%, 30%, 40%, 50%, 60%, 70%, 80%, 90%, or more in T-cell IFN-gamma secretion compared to a reference retroviral vector or VLP, e.g., an unmodified retroviral vector or VLP from a cell otherwise similar to the source cell, wherein T-cell IFN-gamma secretion is assayed in vitro, e.g., by IFN-gamma ELISPOT.

In some embodiments, the retroviral vector or VLP causes a reduction in secretion of immunogenic cytokines, e.g., a reduction of 1%, 5%, 10%, 20%, 30%, 40%, 50%, 60%, 70%, 80%, 90%, or more in secretion of immunogenic cytokines compared to a reference retroviral vector or VLP, e.g., an unmodified retroviral vector or VLP from a cell otherwise similar to the source cell, wherein secretion of immunogenic cytokines is assayed in vitro using ELISA or ELISPOT.

In some embodiments, the retroviral vector or VLP results in increased secretion of an immunosuppressive cytokine, e.g., an increase of 1%, 5%, 10%, 20%, 30%, 40%, 50%, 60%, 70%, 80%, 90%, or more in secretion of an immunosuppressive cytokine compared to a reference retroviral vector or VLP, e.g., an unmodified retroviral vector or VLP from a cell otherwise similar to the source cell, wherein secretion of the immunosuppressive cytokine is assayed in vitro using ELISA or ELISPOT.

In some embodiments, the retroviral vector or VLP has an increase in expression of HLA-G or HLA-E, e.g., an increase in expression of 1%, 5%, 10%, 20%, 30%, 40%, 50%, 60%, 70%, 80%, 90%, or more of HLA-G or HLA-E, compared to a reference retroviral vector or VLP, e.g., an unmodified retroviral vector or VLP from a cell otherwise similar to the source cell, wherein expression of HLA-G or HLA-E is assayed in vitro using flow cytometry, e.g., FACS. In some embodiments, the retroviral vector or VLP is derived from a source cell which is modified to have an increased expression of HLA-G or HLA-E, e.g., compared to an unmodified cell, e.g., an increased expression of 1%, 5%, 10%, 20%, 30%, 40%, 50%, 60%, 70%, 80%, 90%, or more of HLA-G or HLA-E, wherein expression of HLA-G or HLA-E is assayed in vitro using flow cytometry, e.g., FACS. In some embodiments, the retroviral vector or VLP derived from a modified cell with increased HLA-G expression demonstrates reduced immunogenicity.

In some embodiments, the retroviral vector or VLP has or causes an increase in expression of T cell inhibitor ligands (e.g. CTLA4, PD1, PD-L1), e.g., an increase in expression of 1%, 5%, 10%, 20%, 30%, 40%, 50%, 60%, 70%, 80%, 90%, or more of T cell inhibitor ligands as compared to a reference retroviral vector or VLP, e.g., an unmodified retroviral vector or VLP from a cell otherwise similar to the source cell, wherein expression of T cell inhibitor ligands is assayed in vitro using flow cytometry, e.g., FACS.

In some embodiments, the retroviral vector or VLP has a decrease in expression of co-stimulatory ligands, e.g., a decrease of 1%, 5%, 10%, 20%, 30%, 40%, 50%, 60%, 70%, 80%, 90%, or more in expression of co-stimulatory ligands compared to a reference retroviral vector or VLP, e.g., an unmodified retroviral vector or VLP from a cell otherwise similar to the source cell, wherein expression of co-stimulatory ligands is assayed in vitro using flow cytometry, e.g., FACS.

In some embodiments, the retroviral vector or VLP has a decrease in expression of MHC class I or MHC class II, e.g., a decrease in expression of 1%, 5%, 10%, 20%, 30%, 40%, 50%, 60%, 70%, 80%, 90%, or more of MHC Class I or MHC Class II compared to a reference retroviral vector or VLP, e.g., an unmodified retroviral vector or VLP from a cell otherwise similar to the source cell or a HeLa cell, wherein expression of MHC Class I or II is assayed in vitro using flow cytometry, e.g., FACS.

In some embodiments, the retroviral vector or VLP is derived from a cell source, e.g., a mammalian cell source, which is substantially non-immunogenic. In some embodiments, immunogenicity can be quantified, e.g., as described herein. In some embodiments, the mammalian cell source comprises any one, all or a combination of the following features:

a. wherein the source cell is obtained from an autologous cell source; e.g., a cell obtained from a recipient who will be receiving, e.g., administered, the retroviral vector or VLP;
b. wherein the source cell is obtained from an allogeneic cell source which is of matched, e.g., similar, gender to a recipient, e.g., a recipient described herein who will be receiving, e.g., administered; the retroviral vector or VLP;
c. wherein the source cell is obtained is from an allogeneic cell source is which is HLA matched with a recipient's HLA, e.g., at one or more alleles;
d. wherein the source cell is obtained is from an allogeneic cell source which is an HLA homozygote;
e. wherein the source cell is obtained is from an allogeneic cell source which lacks (or has reduced levels compared to a reference cell) MHC class I and II; or
f. wherein the source cell is obtained is from a cell source which is known to be substantially non-immunogenic including but not limited to a stem cell, a mesenchymal stem cell, an induced pluripotent stem cell, an embryonic stem cell, a sertoli cell, or a retinal pigment epithelial cell.

In some embodiments, the subject to be administered the retroviral vector or VLP has, or is known to have, or is tested for, a pre-existing antibody (e.g., IgG or IgM) reactive with a retroviral vector or VLP. In some embodiments, the subject to be administered the retroviral vector or VLP does not have detectable levels of a pre-existing antibody reactive with the retroviral vector or VLP. Tests for the antibody are described, e.g., in Example 13.

In some embodiments, a subject that has received the retroviral vector or VLP has, or is known to have, or is tested for, an antibody (e.g., IgG or IgM) reactive with a retroviral vector or VLP. In some embodiments, the subject that received the retroviral vector or VLP (e.g., at least once, twice, three times, four times, five times, or more) does not have detectable levels of antibody reactive with the retroviral vector or VLP. In embodiments, levels of antibody do not rise more than 1%, 2%, 5%, 10%, 20%, or 50% between two timepoints, the first timepoint being before the first administration of the retroviral vector or VLP, and the second timepoint being after one or more administrations of the retroviral vector or VLP. Tests for the antibody are described, e.g., in Example 14.

VI. Exogenous agents

In some embodiments, a fusosome, e.g. retroviral vector, VLP, or pharmaceutical composition described herein contains an exogenous agent. In some embodiments, the fusosome, e.g. a retroviral vector, VLP, or pharmaceutical composition described herein contains a nucleic acid that encodes an exogenous agent. A. Exogenous protein agents In some embodiments, the exogenous agent comprises a cytosolic protein, e.g., a protein that is produced in the recipient cell and localizes to the recipient cell cytoplasm. In some embodiments, the exogenous agent comprises a secreted protein, e.g., a protein that is produced and secreted by the recipient cell. In some embodiments, the exogenous agent comprises a nuclear protein, e.g., a protein that is produced in the recipient cell and is imported to the nucleus of the recipient cell. In some embodiments, the exogenous agent comprises an organellar protein (e.g., a mitochondrial protein), e.g., a protein that is produced in the recipient cell and is imported into an organelle (e.g., a mitochondrial) of the recipient cell. In some embodiments, the protein is a wild-type protein or a mutant protein. In some embodiments the protein is a fusion or chimeric protein.

In some embodiments, a fusosome described herein comprises a nucleic acid, e.g., RNA or DNA. In some embodiments, the nucleic acid is, comprises, or consists of one or more natural nucleic acid residues. In some embodiments, the nucleic acid is, comprises, or consists of one or more nucleic acid analogs. In some embodiments, the nucleic acid has a nucleotide sequence that encodes a functional gene product such as an RNA or protein. In some embodiments, the nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, the nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, the nucleic acid is partly or wholly single stranded; in some embodiments, the nucleic acid is partly or wholly double stranded. In some embodiments the nucleic acid has a nucleotide sequence comprising at least one element that encodes, or is the complement of a sequence that encodes, a polypeptide. The nucleic acid may incude variants, e.g., having an overall sequence identity with a reference nucleic acid of at least 85%, 86%, 87%, 88%, 89%, 90%, 91%, 92%, 93%, 94%, 95%, 96%, 97%, or 99%. In some embodiments, a variant nucleic acid does not share at least one characteristic sequence element with a reference nucleic acid. In some embodiments, a variant nucleic acid shares one or more of the biological activities of the reference nucleic acid. In some embodiments, a nucleic acid variant has a nucleic acid sequence that is identical to that of the reference but for a small number of sequence alterations at particular positions. In some embodiments, fewer than about 20%, about 15%, about 10%, about 9%, about 8%, about 7%, about 6%, about 5%, about 4%, about 3%, or about 2% of the residues in a variant are substituted, inserted, or deleted, as compared to the reference. In some embodiments, a variant nucleic acid comprises about 10, about 9, about 8, about 7, about 6, about 5, about 4, about 3, about 2, or about 1 substituted residues as compared to a reference. In some embodiments, a variant nucleic acid comprises a very small number (e.g., fewer than about 5, about 4, about 3, about 2, or about 1) number of substituted, inserted, or deleted, functional residues that participate in a particular biological activity relative to the reference. In some embodiments, a variant nucleic acid comprises not more than about 15, about 12, about 9, about 3, or about 1 addition or deletion, and, in some embodiments, comprises no additions or deletions, as compared to the reference. In some embodiments, a variant nucleic acid comprises fewer than about 27, about 24, about 21, about 18, about 15, about 12, about 9, about 6, about 3, or fewer than about 9, about 6, about 3, or about 2 additions or deletions as compared to the reference.

In some embodiments, a fusosome described herein comprises an exogenous agent which comprises a protein. The protein may include moieties other than amino acids (e.g., may be glycoproteins, proteoglycans, etc.) and/or may be otherwise processed or modified. The protein can sometimes include more than one polypeptide chain, for example linked by one or more disulfide bonds or associated by other means. The protein may contain L-amino acids, D-amino acids, or both and may contain any of a variety of amino acid modifications or analogs. In some embodiments, proteins may comprise natural amino acids, non-natural amino acids, synthetic amino acids, and combinations thereof. In some embodiments, proteins are antibodies, antibody fragments, biologically active portions thereof, and/or characteristic portions thereof. A polypeptide may include its variants, e.g., having an overall sequence identity with a reference polypeptide of at least 85%, 86%, 87%, 88%, 89%, 90%, 91%, 92%, 93%, 94%, 95%, 96%, 97%, or 99%. In some embodiments, a variant polypeptide does not share at least one characteristic sequence element with a reference polypeptide. In some embodiments, a variant polypeptide shares one or more of the biological activities of the reference polypeptide. In some embodiments, a polypeptide variant has an amino acid sequence that is identical to that of the reference but for a small number of sequence alterations at particular positions. In some embodiments, fewer than about 20%, about 15%, about 10%, about 9%, about 8%, about 7%, about 6%, about 5%, about 4%, about 3%, or about 2% of the residues in a variant are substituted, inserted, or deleted, as compared to the reference. In some embodiments, a variant polypeptide comprises about 10, about 9, about 8, about 7, about 6, about 5, about 4, about 3, about 2, or about 1 substituted residues as compared to a reference. In some embodiments, a variant polypeptide comprises a very small number (e.g., fewer than about 5, about 4, about 3, about 2, or about 1) number of substituted, inserted, or deleted, functional that participate in a particular biological activity relative to the reference. In some embodiments, a variant polypeptide comprises not more than about 5, about 4, about 3, about 2, or about 1 addition or deletion, and, in some embodiments, comprises no additions or deletions, as compared to the reference. In some embodiments, a variant polypeptide comprises fewer than about 25, about 20, about 19, about 18, about 17, about 16, about 15, about 14, about 13, about 10, about 9, about 8, about 7, about 6, and commonly fewer than about 5, about 4, about 3, or about 2 additions or deletions as compared to the reference.

In some embodiments, the exogenous agent comprises an exogenous agent of Table 5 below. In some embodiments, the exogenous agent comprises a chimeric antigen receptor (CAR) molecule provided in Table 5. In some embodiments, the exogenous agent comprises a binding moiety that binds to an antigen provided in Table 5.

In some embodiments, the exogenous agent comprises a binding moiety that binds to a fragment of an antigen provided in Table 5, e.g., an antigenic peptide of an antigen provided in Table 5. In some embodiments, the exogenous agent comprises a binding moiety that binds to a MHC molecule (e.g., a MHC class I molecule or a MHC class II molecule) complexed with a fragment of an antigen provided in Table 5. In some embodiments, the binding moiety is a TCR molecule.

TABLE 5

T cell-related (e.g., Treg-related) diseases or disorders. The second column lists exogenous agents that can be delivered to treat the indications in the third column, according to the methods and uses herein.

| Antigen | Exogenous agent | Disease/Disorder |
|---|---|---|
| an organ target that is related to the orgen that is | A CAR molecule that binds to an organ target that is related to the organ that is | Acute GvHD |

TABLE 5-continued

T cell-related (e.g., Treg-related) diseases or disorders. The second column lists exogenous agents that can be delivered to treat the indications in the third column, according to the methods and uses herein.

| Antigen | Exogenous agent | Disease/Disorder |
|---|---|---|
| transplanted, e.g., a target present in the transplanted organ | transplanted | |
| a hair follicle keratinocyte antigen or a melanocyte antigen | A CAR molecule that binds to a hair follicle keratinocyte antigen or a melanocyte antigen | Alopecia Areata |
| CXCL8, CXCL9, CXCL10, CXCL11,CCL2, CCL5, or intercellular adhesion molecule 1 | A CAR molecule that binds to CXCL8, CXCL9, CXCL10, CXCL11, CCL2, CCL5, or intercellular adhesion molecule 1 | Autoimmune Uveitis |
| gluten | A CAR molecule that binds to gluten | Celiac Disease |
| PDGF | A CAR molecule that binds to PDGF | Chronic GvHD |
| bacterial flagellin or FAM84A | A CAR molecule that binds to bacterial flagellin or FAM84A | Crohn's Disease |
| Alpha(2)-Heremans Schmidt glycoprotein (alpha(2)-HSG), transferrin, or carbonic anhydrase | A CAR molecule that binds to Alpha(2)-Heremans Schmidt glycoprotein (alpha(2)-HSG), transferrin, or carbonic anhydrase | Endometriosis |
| a food-based antigen, e.g., an antigen present in a food | A CAR molecule that binds to a food-based antigen | Eosinophilic Esophagitis |
| thyroid-stimulating hormone receptor (TSHR) | A CAR molecule that binds to thyroid-stimulating hormone receptor (TSHR) | Graves' Disease |
| thryoid peroxidase, thyroglobulin, or the TSH receptor | A CAR molecule that binds to thryoid peroxidase, thyroglobulin, or the TSH receptor | Hashimoto's Thyroiditis |
| alpha-enolase, alpha b-crystallin, beta-arrestin, S100-beta, aquaporin-4, MOG, PLP, or MBP | A CAR molecule that binds to alpha-enolase, alpha b-crystallin, beta-arrestin, S100-beta, aquaporin-4, MOG, PLP, or MBP | Multiple Sclerosis |
| nAChR or MuSK | A CAR molecule that binds to nAChR or MuSK | Myasthenia Gravis |
| the NC16A terminal of BPAG1/2 | A CAR molecule that binds to the NC16A terminal of BPAG1/2 | Pemphigoid |
| Desmoglein 1, Desmoglein 3, BPAG1, plectin, desmoplakin I, desmoplakin II, envoplakin, periplakin, or alpha-2-macroglobulin-like-1 | A CAR molecule that binds to Desmoglein 1, Desmoglein 3, BPAG1, plectin, desmoplakin I, desmoplakin II, envoplakin, periplakin, or alpha-2-macroglobulin-like-1 | Pemphigus |
| a citrullinated peptide | A CAR molecule that binds to a citrullinated peptide | Rheumatoid Arthritis |
| a non-self antigen | A CAR molecule that binds to a non-self antigen | Solid Organ Transplant |
| dsDNA, nucelosome histones, telomeres, or a Sm core protein | A CAR molecule that binds to dsDNA, nucelosome histones, telomeres, or a Sm core protein | Systemic Lupus Erythmatosus |
| hsp60, 437-460 (p277), PPIns/Pins, an anti-insulin antigen, glutamate decarboxylase (GAD), carboxypeptidase H, insulinoma antigen-2, or IA-2β | A CAR molecule that binds to hsp60, 437-460 (p277), PPIns/Pins, an anti-insulin antigen, glutamate decarboxylase (GAD), carboxypeptidase H, insulinoma antigen-2, or IA-2β | Type 1 Diabetes |
| an antigen in the cytoplasm of neutrophil granulocytes or FAM84A | A CAR molecule that binds to an antigen in the cytoplasm of neutrophil granulocytes or FAM84A | Ulcerative Colitis |

In some embodiments, for the treatment of Celiac Disease, Crohn's Disease, or Ulcerative Colitis, a GI chemokine and/or adhesion molecule may be utilized to direct Treg homing to the gut.

In some embodiments, the exogenous agent is a binding moiety (e.g., a CAR molecule) that binds to an antigen. In some embodiments, the antigen is an antigen disclosed in James, William D.; et al. (2006) Andrews' Diseases of the Skin: Clinical Dermatology. Saunders Elsevier, herein incorporated by reference in its entirety, for the treatment of Pemphigoid or Pemphigus, e.g., when the target cell is a Treg cell. In some embodiments, the antigen is an antigen, e.g., a B cell antigen, e.g., an autoantigen on B cells, disclosed in WO2018127584 and WO2018127585, herein incorporated by reference in their entireties, e.g., when the target cell is a Treg cell. In some embodiments, the antigen is an autoantigen disclosed in WO2016020056, herein incorporated by reference in its entirety, for the treatment of autoimmune disorders, e.g., when the target cell is a Treg cell. In some embodiments, the antigen is an antigen disclosed in US20110311590, herein incorporated by reference in its entirety, for the treatment of allergic and/or asthmatic diseases or disorders. In some embodiments, the antigen is an antigen disclosed in WO2012131419, herein incorporated by reference in its entirety, e.g., when the target cell is a Treg cell. In some embodiments, the antigen is an antigen disclosed in WO2012046139, herein incorporated by reference in its entirety, e.g., when the target cell is a Tr1 cell. In some embodiments, the antigen is an antigen disclosed in WO2017143094, herein incorporated by reference in its entirety, e.g., when the target cell is a T follicular regulatory (TFR) cell. In some embodiments, the antigen is an antigen disclosed in US20180251731, herein incorporated by reference in its entirety, e.g., when the target cell is a CD8+ CD45RC$^{low}$ Treg cell. In some embodiments, the antigen is an antigen disclosed in US20170274095, herein incorporated by reference in its entirety, e.g., when the target cell is a Treg cell. In some embodiments, the antigen is an antigen disclosed in WO2017218850, herein incorporated by reference in its entirety, e.g., when the target cell is a Treg cell.

In some embodiments, the CAR molecule is a CAR molecule disclosed in WO2018127584; WO2018127585; WO2016020056; WO2012131419; WO2012131419; US20110311590; WO2017143094; US20180251731; US20170274095; WO2017218850; Yoon J, et al., Blood (2017) 129 (2): 238-45; Mekala D J, Geiger T L. Blood (2005) 105 (5): 2090-2; Elinav E, et al., Gastroenterology (2009) 136 (5): 1721-31; Fransson M, et al., J Neuroinflammation (2012) 9:112; Blat D, et al., Mol Ther (2014) 22 (5): 1018-28; MacDonald K G, et al., J Clin Invest (2016) 126 (4): 1413-24; Raffin C. J Immunol (2016) 196 (1 Suppl): 210.219; Boardman D A, et al., Am J Transplant (2017) 17 (4): 931-43; Noyan F, et al., Am J Transplant (2017) 17 (4): 917-30; Pierini A, et al., JCI Insight (2017) 2 (20), herein incorporated by reference in their entireties.

In some embodiments, the exogenous agent is a chimeric autoantibody receptor (CAAR) disclosed in Ellebrecht C T, et al., Science. 2016 Jul. 8; 353 (6295): 179-184, herein incorporated by reference in its entirety. In some embodiments, the CAAR has high affinity to autoantibodies expressed on B cells. In another embodiment, the cell expresses the CAAR and induces killing of B cells expressing autoantibodies. In some embodiments, the CAAR can thus target an autoimmune antigen. CAARs comprise an extracellular autoantigen, such as an autoantigen involved in an autoimmune disease, fused to intracellular signaling domains. In particular embodiments, the autoantigen is recognized by an autoantibody, and can thereby direct killing of autoreactive B lymphocytes through the specificity of the B cell receptor (BCR). In a specific embodiment, a CAAR contains the PV autoantigen, desmoglien 3 (Dsg3). In some embodiments, the CAAR can target autoantibodies to Dsg3, which can control the progression of the autoimmune disease Pemphigus vulgaris (PV). See e.g. WO2015/168613. Examples of the intracellular signaling domains of a CAAR include, without being limited to, T or NK receptor signaling domains. In some embodiments, a CAAR contains a co-stimulatory moiety in tandem with an activation moiety, for example CD3C. Examples of co-stimulatory domains include, but are not limited to, ICOS, OX40 (CD134), CD28, 4-1BB (CD137), CD27 and DAP10. In some embodiments, the CARR includes a CD137-CD36 signaling domain. In some embodiments, the exogenous agent is a B-cell-targeting antibody receptor disclosed in Zhang A H, et al., Blood (2016) 128 (22): 329, herein incorporated by reference in its entirety.

In some embodiments, the protein agent is other than a clotting factor, e.g., other than Factor VII or Factor IX. In some embodiments, the protein agent is other than a reporter protein, e.g., fluorescent protein, e.g., GFP or luciferase. In some the protein agent is other than a cell surface receptor, an NGF receptor, galactocerebrosidase, gp91 phox, IFN-alpha, TK, GCV, and autoimmune antigen, cytokine, angiogenesis inhibitor, or anti-cancer agent, or a fragment or variant thereof.

B. CAR Molecules

In some embodiments, a payload gene described herein encodes a chimeric antigen receptor (CAR) comprising an antigen binding domain. In some embodiments, an exogenous agent described herein comprises a chimeric antigen receptor (CAR) comprising an antigen binding domain. In some embodiments, the payload is or comprises a chimeric antigen receptor (CAR) comprising an antigen binding domain. In some embodiments, the CAR is or comprises a first generation CAR comprising an antigen binding domain, a transmembrane domain, and signaling domain (e.g., one, two or three signaling domains). In some embodiments, the CAR comprises a third generation CAR comprising an antigen binding domain, a transmembrane domain, and at least three signaling domains. In some embodiments, a fourth generation CAR comprising an antigen binding domain, a transmembrane domain, three or four signaling domains, and a domain which upon successful signaling of the CAR induces expression of a cytokine gene. In some embodiments, the antigen binding domain is or comprises an scFv or Fab.

In some embodiments, the CAR molecule is a CAR molecule disclosed in WO2018127584; WO2018127585; WO2016020056; WO2012131419; WO2012131419; US20110311590; WO2017143094; US20180251731; US20170274095; WO2017218850; Yoon J, et al., Blood (2017) 129 (2): 238-45; Mekala D J, Geiger T L. Blood (2005) 105 (5): 2090-2; Elinav E, et al., Gastroenterology (2009) 136 (5): 1721-31; Fransson M, et al., J Neuroinflammation (2012) 9:112; Blat D, et al., Mol Ther (2014) 22 (5): 1018-28; MacDonald K G, et al., J Clin Invest (2016) 126 (4): 1413-24; Raffin C. J Immunol (2016) 196 (1 Suppl): 210.219; Boardman D A, et al., Am J Transplant (2017) 17 (4): 931-43; Noyan F, et al., Am J Transplant (2017) 17 (4): 917-30; Pierini A, et al., JCI Insight (2017) 2 (20), herein incorporated by reference in their entireties.

In some embodiments, the antigen binding domain targets an antigen characteristic of a neoplastic cell. In some embodiments, the antigen characteristic of a neoplastic cell is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, Epidermal Growth Factor Receptors (EGFR) (including ErbB1/EGFR, ErbB2/HER2, ErbB3/HER3, and ErbB4/HER4), Fibroblast Growth Factor Receptors (FGFR) (including FGF1, FGF2, FGF3, FGF4, FGF5, FGF6, FGF7, FGF18, and FGF21) Vascular Endothelial Growth Factor Receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GABA receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multispan transmembrane protein, T-cell receptor motifs; T-cell alpha chains; T-cell β chains; T-cell y chains; T-cell & chains; CCR7; CD3; CD4; CD5; CD7;

CD8; CD11b; CD11c; CD16; CD19; CD20; CD21; CD22; CD25; CD28; CD34; CD35; CD40; CD45RA; CD45RO; CD52; CD56; CD62L; CD68; CD80; CD95; CD117; CD127; CD133; CD137 (4-1 BB); CD163; F4/80; IL-4Ra; Sca-1; CTLA-4; GITR; GARP; LAP; granzyme B; LFA-1; transferrin receptor; NKp46, perforin, CD4+; Th1; Th2; Th17; Th40; Th22; Th9; Tfh, Canonical Treg. FoxP3+; Tr1; Th3; Treg17; TREG; CDCP1, NT5E, EpCAM, CEA, gpA33, Mucins, TAG-72, Carbonic anhydrase IX, PSMA, Folate binding protein, Gangliosides (e.g., CD2, CD3, GM2), Lewis-72, VEGF, VEGFR 1/2/3, aVB3, a5B1, ErbB1/EGFR, ErbB1/HER2, ErB3, c-MET, IGFIR, EphA3, TRAIL-R1, TRAIL-R2, RANKL, FAP, Tenascin, PDL-1, BAFF, HDAC, ABL, FLT3, KIT, MET, RET, IL-1B, ALK, RANKL, mTOR, CTLA-4, IL-6, IL-6R, JAK3, BRAF, PTCH, Smoothened, PIGF, ANPEP, TIMP1, PLAUR, PTPRJ, LTBR, or ANTXR1, Folate receptor alpha (FRa), ERBB2 (Her2/neu), EphA2, IL-13Ra2, epidermal growth factor receptor (EGFR), Mesothelin, TSHR, CD19, CD123, CD22, CD30, CD171, CS-1, CLL-1, CD33, EGFRvIII, GD2, GD3, BCMA, MUC16 (CA125), LICAM, LeY, MSLN, IL13Ra1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gplOO, bcr-abl, tyrosinase, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLACI, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, ETV6-AML, sperm protein 17, XAGE1, Tie 2, MAD-CT-1, MAD-CT-2, Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A, B,C) CD49f, CD151 CD340, CD200, tkrA, trkB, or trkC, or an antigenic fragment or antigenic portion thereof.

In some embodiments, the antigen binding domain targets an antigen characteristic of a T-cell. In some embodiments, the antigen characteristic of a T-cell is selected from a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T-cell. In some embodiments, an antigen characteristic of a T-cell may be a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, AKT1; AKT2; AKT3; ATF2; BCL10; CALM1; CD3D (CD38); CD3E (CD38); CD3G (CD3); CD4; CD8; CD28; CD45; CD80 (B7-1); CD86 (B7-2); CD247 (CD35); CTLA4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38B); MAPK12 (p38y); MAPK13 (p388); MAPK14 (p38a); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.

In some embodiments, the antigen binding domain targets an antigen characteristic of an autoimmune or inflammatory disorder. In some embodiments, the autoimmune or inflammatory disorder is selected from chronic graft-vs-host disease (GVHD), lupus, arthritis, immune complex glomerulonephritis, goodpasture, uveitis, hepatitis, systemic sclerosis or scleroderma, type I diabetes, multiple sclerosis, cold agglutinin disease, Pemphigus vulgaris, Grave's disease, autoimmune hemolytic anemia, Hemophilia A, Primary Sjogren's Syndrome, thrombotic thrombocytopenia purrpura, neuromyelits optica, Evan's syndrome, IgM mediated neuropathy, cyroglobulinemia, dermatomyositis, idiopathic thrombocytopenia, ankylosing spondylitis, bullous pemphigoid, acquired angioedema, chronic urticarial, antiphospholipid demyelinating polyneuropathy, and autoimmune thrombocytopenia or neutropenia or pure red cell aplasias, while exemplary non-limiting examples of alloimmune diseases include allosensitization (see, for example, Blazar et al., 2015, Am. J. Transplant, 15 (4): 931-41) or xenosensitization from hematopoietic or solid organ transplantation, blood transfusions, pregnancy with fetal allosensitization, neonatal alloimmune thrombocytopenia, hemolytic disease of the newborn, sensitization to foreign antigens such as can occur with replacement of inherited or acquired deficiency disorders treated with enzyme or protein replacement therapy, blood products, and gene therapy. In some embodiments, the antigen characteristic of an an autoimmune or inflammatory disorder is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor. In some embodiments, a CAR antigen binding domain binds to a ligand expressed on B cells, plasma cells, plasmablasts, CD10, CD19, CD20, CD22, CD24, CD27, CD38, CD45R, CD138, CD319, BCMA, CD28, TNF, interferon receptors, GM-CSF, ZAP-70, LFA-1, CD3 gamma, CD5 or CD2. See US 2003/0077249; WO 2017/058753; WO 2017/058850, the contents of which are herein incorporated by reference.

In some embodiments, the antigen binding domain targets an antigen characteristic of an infectious disease. In some embodiments, wherein the infectious disease is selected from HIV, hepatitis B virus, hepatitis C virus, Human herpes virus, Human herpes virus 8 (HHV-8, Kaposi sarcoma-associated herpes virus (KSHV)), Human T-lymphotrophic virus-1 (HTLV-1), Merkel cell polyomavirus (MCV), Simian virus 40 (SV40), Epstein-Barr virus, CMV, human papillomavirus. In some embodiments, the antigen characteristic of an infectious disease is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, HIV Env, gp120, or CD4-induced epitope on HIV-1 Env.

In some embodiments, the CAR transmembrane domain comprises at least a transmembrane region of the alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, or functional variant thereof. In some embodiments, the transmembrane domain comprises at least a transmembrane region(s) of CD8a, CD8B, 4-1BB/CD137, CD28, CD34, CD4, FcεRIγ, CD16, OX40/CD134, CD35, CD3, CD3γ, CD38, TCRα, TCRβ, TCRζ, CD32, CD64, CD64, CD45, CD5, CD9, CD22, CD37, CD80, CD86, CD40, CD40L/CD154, VEGFR2, FAS, and FGFR2B, or functional variant thereof.

In some embodiments, the CAR comprises at least one signaling domain selected from one or more of B7-1/CD80; B7-2/CD86; B7-H1/PD-L1; B7-H2; B7-H3; B7-H4; B7-H6; B7-H7; BTLA/CD272; CD28; CTLA-4; Gi24/VISTA/B7-H5; ICOS/CD278; PD-1; PD-L2/B7-DC; PDCD6); 4-1BB/TNFSF9/CD137; 4-1BB Ligand/TNFSF9; BAFF/BLyS/TNFSF13B; BAFF R/TNFRSF13C; CD27/TNFRSF7; CD27 Ligand/TNFSF7; CD30/TNFRSF8; CD30 Ligand/TNFSF8; CD40/TNFRSF5; CD40/TNFSF5; CD40 Ligand/TNFSF5; DR3/TNFRSF25; GITR/TNFRSF18; GITR Ligand/TNFSF18; HVEM/TNFRSF14; LIGHT/TNFSF14; Lymphotoxin-alpha/TNF-beta; OX40/TNFRSF4; OX40 Ligand/TNFSF4; RELT/TNFRSF19L; TACI/TNFRSF13B; TL1A/TNFSF15; TNF-alpha; TNF RII/TNFRSF1B); 2B4/CD244/SLAMF4; BLAME/SLAMF8; CD2; CD2F-10/SLAMF9; CD48/SLAMF2; CD58/LFA-3; CD84/SLAMF5; CD229/SLAMF3; CRACC/SLAMF7; NTB-A/SLAMF6; SLAM/CD150); CD2; CD7; CD53; CD82/Kai-1; CD90/Thy1; CD96; CD160; CD200; CD300a/LMIR1; HLA Class I; HLA-DR; Ikaros; Integrin alpha 4/CD49d; Integrin alpha 4 beta 1; Integrin alpha 4 beta 7/LPAM-1; LAG-3; TCL1A; TCL1B; CRTAM; DAP12; Dectin-1/CLEC7A; DPPIV/CD26; EphB6; TIM-1/KIM-1/HAVCR; TIM-4; TSLP; TSLP R; lymphocyte function associated antigen-1 (LFA-1); NKG2C, a CD3 zeta domain, an immunoreceptor tyrosine-based activation motif (ITAM), CD27, CD28, 4-1BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83, or functional fragment thereof.

In some embodiments, the CAR comprises a CD3 zeta domain or an immunoreceptor tyrosine-based activation motif (ITAM), or functional variant thereof. In some embodiments, the CAR comprises (i) a CD3 zeta domain, or an immunoreceptor tyrosine-based activation motif (ITAM), or functional variant thereof; and (ii) a CD28 domain, or a 4-1BB domain, or functional variant thereof. In some embodiments, the CAR comprises a (i) a CD3 zeta domain, or an immunoreceptor tyrosine-based activation motif (ITAM), or functional variant thereof; (ii) a CD28 domain or functional variant thereof; and (iii) a 4-1BB domain, or a CD134 domain, or functional variant thereof. In some embodiments, the CAR comprises (i) a CD3 zeta domain, or an immunoreceptor tyrosine-based activation motif (ITAM), or functional variant thereof; (ii) a CD28 domain, or a 4-1BB domain, or functional variant thereof, and/or (iii) a 4-1BB domain, or a CD134 domain, or functional variant thereof. In some embodiments, the CAR comprises a (i) a CD3 zeta domain, or an immunoreceptor tyrosine-based activation motif (ITAM), or functional variant thereof; (ii) a CD28 domain or functional variant thereof; (iii) a 4-1BB domain, or a CD134 domain, or functional variant thereof; and (iv) a cytokine or costimulatory ligand transgene.

In some embodiments, the CAR further comprises one or more spacers, e.g., wherein the spacer is a first spacer between the antigen binding domain and the transmembrane domain. In some embodiments, the first spacer includes at least a portion of an immunoglobulin constant region or variant or modified version thereof. In some embodiments, the spacer is a second spacer between the transmembrane domain and a signaling domain. In some embodiments, the second spacer is an oligopeptide, e.g., wherein the oligopeptide comprises glycine-serine doublets.

In some embodiments the exogenous agent is or comprises a CAR, e.g., a first generation CAR or a nucleic acid encoding a first generation CAR. In some embodiments, a first generation CAR comprises an antigen binding domain, a transmembrane domain, and signaling domain. In some embodiments a signaling domain mediates downstream signaling during T-cell activation.

In some embodiments the exogenous agent is or comprises a second generation CAR or a nucleic acid encoding a second generation CAR. In some embodiments a second generation CAR comprises an antigen binding domain, a transmembrane domain, and two signaling domains. In some embodiments a signaling domain mediates downstream signaling during T-cell activation. In some embodiments a signaling domain is a costimulatory domain. In some embodiments, a costimulatory domain enhances cytokine production, CAR T-cell proliferation, and or CAR T-cell persistence during T cell activation.

In some embodiments the exogenous agent is or comprises a third generation CAR or a nucleic acid encoding a third generation CAR. In some embodiments, a third generation CAR comprises an antigen binding domain, a transmembrane domain, and at least three signaling domains. In some embodiments a signaling domain mediates downstream signaling during T-cell activation. In some embodiments a signaling domain is a costimulatory domain. In some embodiments, a costimulatory domain enhances cytokine production, CAR T-cell proliferation, and or CAR T-cell persistence during T cell activation. In some embodiments, a third generation CAR comprises at least two costimulatory domains. In some embodiments, the at least two costimulatory domains are not the same.

In some embodiments the exogenous is or comprises a fourth generation CAR or a nucleic acid encoding a fourth generation CAR. In some embodiments a fourth generation CAR comprises an antigen binding domain, a transmembrane domain, and at least two, three, or four signaling domains. In some embodiments a signaling domain mediates downstream signaling during T-cell activation. In some embodiments a signaling domain is a costimulatory domain. In some embodiments, a costimulatory domain enhances cytokine production, CAR T-cell proliferation, and or CAR T-cell persistence during T cell activation.

In some embodiments, a first, second, third, or fourth generation CAR further comprises a domain which upon successful signaling of the CAR induces expression of a cytokine gene. In some embodiments, a cytokine gene is endogenous or exogenous to a target cell comprising a CAR which comprises a domain which upon successful signaling of the CAR induces expression of a cytokine gene. In some embodiments a cytokine gene encodes a pro-inflammatory cytokine. In some embodiments a cytokine gene encodes IL-1, IL-2, IL-9, IL-12, IL-18, TNF, or IFN-gamma, or functional fragment thereof. In some embodiments a domain which upon successful signaling of the CAR induces expression of a cytokine gene is or comprises a transcription factor or functional domain or fragment thereof. In some embodiments a domain which upon successful signaling of the CAR induces expression of a cytokine gene is or comprises a transcription factor or functional domain or fragment thereof. In some embodiments a transcription factor or functional domain or fragment thereof is or comprises a nuclear factor of activated T cells (NFAT), an NF-kB, or functional domain or fragment thereof. See, e.g., Zhang. C. et al., Engineering CAR-T cells. Biomarker Research. 5:22 (2017); WO 2016126608; Sha, H. et al. Chimaeric antigen receptor T-cell therapy for tumour immunotherapy. Bioscience Reports Jan. 27, 2017, 37 (1).

In some embodiments, a CAR antigen binding domain is or comprises an antibody or antigen-binding portion thereof. In some embodiments, a CAR antigen binding domain is or comprises an scFv or Fab. In some embodiments a CAR antigen binding domain comprises an scFv or Fab fragment of a T-cell alpha chain antibody; T-cell β chain antibody; T-cell y chain antibody; T-cell 8 chain antibody; CCR7 antibody; CD3 antibody; CD4 antibody; CD5 antibody; CD7 antibody; CD8 antibody; CD11b antibody; CD11c antibody; CD16 antibody; CD19 antibody; CD20 antibody; CD21 antibody; CD22 antibody; CD25 antibody; CD28 antibody; CD34 antibody; CD35 antibody; CD40 antibody; CD45RA antibody; CD45RO antibody; CD52 antibody; CD56 antibody; CD62L antibody; CD68 antibody; CD80 antibody; CD95 antibody; CD117 antibody; CD127 antibody; CD133 antibody; CD137 (4-1 BB) antibody; CD163 antibody; F4/80 antibody; IL-4Ra antibody; Sca-1 antibody; CTLA-4 antibody; GITR antibody GARP antibody; LAP antibody; granzyme B antibody; LFA-1 antibody; or transferrin receptor antibody.

In some embodiments, an antigen binding domain binds to a cell surface antigen of a cell. In some embodiments, a cell surface antigen is characteristic of one type of cell. In some embodiments, a cell surface antigen is characteristic of more than one type of cell.

In some embodiments a CAR antigen binding domain binds a cell surface antigen characteristic of a T-cell. In some embodiments, an antigen characteristic of a T-cell may be a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T-cell. In some embodiments, an antigen characteristic of a T-cell may be a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor.

In some embodiments, an antigen characteristic of a T-cell may be a T-cell receptor. In some embodiments, a T-cell receptor may be AKT1; AKT2; AKT3; ATF2; BCL10; CALM1; CD3D (CD38); CD3E (CD38); CD3G (CD3y); CD4; CD8; CD28; CD45; CD80 (B7-1); CD86 (B7-2); CD247 (CD35); CTLA4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38B); MAPK12 (p38y); MAPK13 (p388); MAPK14 (p38a); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.

In some embodiments a CAR comprises a signaling domain which is a costimulatory domain. In some embodiments a CAR comprises a second costimulatory domain. In some embodiments a CAR comprises at least two costimulatory domains. In some embodiments a CAR comprises at least three costimulatory domains. In some embodiments a CAR comprises a costimulatory domain selected from one or more of CD27, CD28, 4-1BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83.

In addition to the CARs described herein, various chimeric antigen receptors and nucleotide sequences encoding the same are known in the art and would be suitable for fusosomal delivery and reprogramming of target cells in vivo and in vitro as described herein. See, e.g., WO2013040557; WO2012079000; WO2016030414; Smith T, et al., Nature Nanotechnology. 2017. DOI: 10.1038/NNANO.2017.57, the disclosures of which are herein incorporated by reference.

In some embodiments a fusosome comprising a CAR or a nucleic acid encoding a CAR (e.g., a DNA, a gDNA, a cDNA, an RNA, a pre-MRNA, an mRNA, an miRNA, an siRNA, etc.) is delivered to a target cell. In some embodiments the target cell is an effector cell, e.g., a cell of the immune system that expresses one or more Fc receptors and mediates one or more effector functions. In some embodiments, a target cell may include, but may not be limited to, one or more of a monocyte, macrophage, neutrophil, dendritic cell, eosinophil, mast cell, platelet, large granular lymphocyte, Langerhans' cell, natural killer (NK) cell, T-lymphocyte (e.g., T-cell), a Gamma delta T cell, B-lymphocyte (e.g., B-cell) and may be from any organism including but not limited to humans, mice, rats, rabbits, and monkeys.

VII. Insulator Elements

In some embodiments, a fusosome, retroviral or lentiviral vector, or VLP further comprises one or more insulator elements, e.g., an insulator element described herein. Insulators elements may contribute to protecting lentivirus-expressed sequences, e.g., therapeutic polypeptides, from integration site effects, which may be mediated by cis-acting elements present in genomic DNA and lead to deregulated expression of transferred sequences (e.g., position effect; see, e.g., Burgess-Beusse et al, 2002, Proc. Natl. Acad. Sci., USA, 99:16433; and Zhan et al, 2001, Hum. Genet., 109: 471) or deregulated expression of endogenous sequences adjacent to the transferred sequences. In some embodiments, transfer vectors comprise one or more insulator element the 3' LTR and upon integration of the provirus into the host genome, the provirus comprises the one or more insulators at the 5' LTR and/or 3' LTR, by virtue of duplicating the 3' LTR. Suitable insulators include, but are not limited to, the chicken β-globin insulator (see Chung et al, 1993. Cell 74:505; Chung et al, 1997. N4S 94:575; and Bell et al., 1999. Cell 98:387, incorporated by reference herein) or an insulator from a human β-globin locus, such as chicken HS4. In some embodiments the insulator binds CCCTC binding factor (CTCF). In some embodiments the insulator is a barrier insulator. In some embodiments the insulator is an enhancer-blocking insulator. See, e.g., Emery et al., Human Gene Therapy, 2011, and in Browning and Trobridge, Biomedicines, 2016, both of which are included in their entirety by reference.

In some embodiments, insulators in the retroviral nucleic acid reduce genotoxicity in recipient cells. Genotoxicity can be measured, e.g., as described in Cesana et al, "Uncovering and dissecting the genotoxicity of self-inactivating lentiviral vectors in vivo" Mol Ther. 2014 April; 22 (4): 774-85. doi:10.1038/mt.2014.3. Epub 2014 Jan. 20.

VIII. Assessing Fusosome Content of Target Cell

The present disclosure also provides, in some aspects, a method of assessing fusosome content of a target cell (e.g., fusosome fusion to a target cell) in a subject, comprising providing a biological sample from a subject that has received a fusosome composition (e.g., a fusosome composition described herein), and performing an assay to determine one or more properties of the biological sample resulting from fusion of a target cell in the biological sample with a fusosome as described herein. In some aspects, the disclosure provides a method of measuring fusion with a target cell, e.g., as described in Example 71. In some embodiments, determining one or more properties of the biological sample comprises determining: the presence of a fusogen, the level of a cargo or payload, or an activity relating to a cargo or payload.

In some aspects, the present disclosure provides a method of assessing fusosome content of a target cell (e.g., fusosome fusion to a target cell) in a subject, comprising providing a biological sample from a subject that has received a fusosome composition, e.g., as described herein, and testing the biological sample for the presence of a fusogen, e.g., a fusogen described herein. In some instances, the level of the fusogen detected is greater (e.g., at least about 5%, 10%, 20%, 30%, 40%, 50%, 60%, 70%, 80%, 90%, 100%, 200%, 300%, 400%, 500%, 600%, 700%, 800%, 900%, 1000%, 2000%, 3000%, 4000%, 5000%, 10,000%, 50,000%, or 100,000% greater) than that observed in a corresponding biological sample from a subject that has not received a fusosome composition. In some embodiments, the subject is the same subject prior to administration of the fusosome composition, and in some embodiments, the subject is a different subject.

In some aspects, the present disclosure provides a method of assessing fusosome content of a target cell (e.g., fusosome fusion to a target cell) in a subject, comprising providing a biological sample from a subject that has received a fusosome composition, e.g., as described herein, and testing the biological sample for the presence of a cargo or payload, e.g., delivered by a fusosome as described herein. In some instances, the level of the cargo or payload detected is greater (e.g., at least about 5%, 10%, 20%, 30%, 40%, 50%, 60%, 70%, 80%, 90%, 100%, 200%, 300%, 400%, 500%, 600%, 700%, 800%, 900%, 1000%, 2000%, 3000%, 4000%, 5000%, 10,000%, 50,000%, or 100,000% greater) than that observed in a corresponding biological sample from a subject that has not received a fusosome composition. In some embodiments, the subject is the same subject prior to administration of the fusosome composition, and in some embodiments, the subject is a different subject.

In some aspects, the present disclosure provides a method of assessing fusosome content of a target cell (e.g., fusosome fusion to a target cell in a subject), comprising providing a biological sample from a subject that has received a fusosome composition, e.g., as described herein, and testing the biological sample for alteration of an activity relating to the fusosome composition, e.g., an activity relating to a cargo or payload delivered by the fusosome composition. In some instances, the level of the activity detected is increased, e.g., by at least about 5%, 10%, 20%, 30%, 40%, 50%, 60%, 70%, 80%, 90%, 100%, 200%, 300%, 400%, 500%, 600%, 700%, 800%, 900%, 1000%, 2000%, 3000%, 4000%, 5000%, 10,000%, 50,000%, or 100,000%, relative to that of a corresponding biological sample from a subject that has not received a fusosome composition (e.g., the same subject prior to administration of the fusosome composition). In some instances, the level of the activity detected is decreased, e.g., by at least about 5%, 10%, 20%, 30%, 40%, 50%, 60%, 70%, 80%, 90%, 100%, 200%, 300%, 400%, 500%, 600%, 700%, 800%, 900%, 1000%, 2000%, 3000%, 4000%, 5000%, 10,000%, 50,000%, or 100,000%, relative to that of a corresponding biological sample from a subject that has not received a fusosome composition. In some embodiments, the subject is the same subject prior to administration of the fusosome composition, and in some embodiments, the subject is a different subject.

In one aspect, the present disclosure provides a method of assessing fusosome fusion to a target cell in a subject, comprising providing a biological sample from a subject that has received a fusosome composition, e.g., as described herein, and assessing a level of unfused fusosomes in the biological sample.

In some embodiments of the methods of assessing fusosome content of a target cell (e.g., fusosome fusion to a target cell), resulting in formation of a recipient cell, in the subject, the method further comprises collecting the biological sample from the subject. In embodiments, the biological sample includes one or more recipient cells.

In some embodiments of the methods of assessing fusosome content of a target cell (e.g., fusosome fusion to a target cell) in the subject, the method further comprises separating recipient cells in the biological sample from unfused fusosomes in the biological sample, e.g., by centrifugation. In some embodiments, the method further comprises enriching recipient cells relative to unfused fusosomes in the biological sample, e.g., by centrifugation. In some embodiments, the method further comprises enriching target cells relative to non-target cells in the biological sample, e.g., by FACS.

In some embodiments of the methods of assessing fusosome content of a target cell (e.g., fusosome fusion to a target cell) in a subject, the activity relating to the fusosome composition is chosen from the presence or level of a metabolite, the presence or level of a biomarker (e.g., a protein level or post-translational modification, e.g., phosphorylation or cleavage).

In some embodiments of the methods of assessing fusosome content of a target cell (e.g., fusosome fusion to a target cell) in a subject, the activity relating to the fusosome composition is immunogenicity. In embodiments, the target cell is a CD3+ cell and the biological sample is a blood sample collected from the subject. In embodiments, blood cells are enriched from the blood sample, e.g., using a buffered ammonium chloride solution. In embodiments, enriched blood cells are incubated with an anti-CD3 antibody (e.g., a murine anti-CD3-FITC antibody) and CD3+ cells are selected, e.g., by fluorescence activated cell sorting. In embodiments, cells, e.g., sorted cells, e.g., CD3+ cells are analyzed for the presence of antibodies on the cell surface, e.g., by staining with an anti-IgM antibody. In some embodiments, if antibodies are present at a level above a reference level, the subject is identified as having an immune response against recipient cells.

In embodiments, immunogenicity is assayed by a cell lysis assay. In embodiments, recipient cells from the biological sample are co-incubated with immune effector cells capable of lysing other cells. In embodiments, the immune effector cells are from the subject or from a subject not administered the fusosome composition. For instance, in embodiments, immunogenicity is assessed by a PBMC cell lysis assay. In embodiments, recipient cells from the biological sample are co-incubated with peripheral blood mononuclear cells (PBMCs) from the subject or control PBMCs from a subject not administered the fusosome composition and then assessed for lysis of the recipient cells by PBMCs. In embodiments, immunogenicity is assessed by a natural killer (NK) cell lysis assay. In embodiments, recipient cells are co-incubated with NK cells from the subject or control NK cells from a subject not administered the fusosome composition and then assessed for lysis of the recipient cells by the NK cells. In embodiments, immunogenicity is assessed by a CD8+ T-cell lysis assay. In embodiments, recipient cells are co-incubated with CD8+ T-cells from the subject or control CD8+ T-cells from a subject not administered the fusosome composition and then assessed for lysis of the target cells by the CD8+ T-cells. In some embodiments, if cell lysis occurs at a level above a reference level, the subject is identified as having an immune response against recipient cells.

In some embodiments, immunogenicity is assayed by phagocytosis of recipient cells, e.g., by macrophages. In embodiments, recipient cells are not targeted by macrophages for phagocytosis. In embodiments, the biological sample is a blood sample collected from the subject. In embodiments, blood cells are enriched from the blood sample, e.g., using a buffered ammonium chloride solution. In embodiments, enriched blood cells are incubated with an anti-CD3 antibody (e.g., a murine anti-CD3-FITC antibody) and CD3+ cells are selected, e.g., by fluorescence activated cell sorting. In embodiments, fluorescently-labeled CD3+ cells are incubated with macrophages and then tested for intracellular fluorescence within the macrophages, e.g., by flow cytometry. In some embodiments, if macrophage phagocytosis occurs at a level above a reference level, the subject is identified as having an immune response against recipient cells.

IX. Physical and Functional Characteristics of Fusosomes

In some embodiments, the fusosome is capable of delivering (e.g., delivers) an agent, e.g., a protein, nucleic acid (e.g., mRNA), organelle, or metabolite to the cytosol of a target cell. Similarly, in some embodiments, a method herein comprises delivering an agent to the cytosol of a target cell. In some embodiments, the agent is a protein (or a nucleic acid encoding the protein, e.g., an mRNA encoding the protein) which is absent, mutant, or at a lower level than wild-type in the target cell. In some embodiments, the target cell is from a subject having a genetic disease, e.g., a monogenic disease, e.g., a monogenic intracellular protein disease. In some embodiments, the agent comprises a transcription factor, e.g., an exogenous transcription factor or an endogenous transcription factor. In some embodiments, the fusosome further comprises, or the method further comprises delivering, one or more (e.g., at least 2, 3, 4, 5, 10, 20, or 50) additional transcription factors, e.g., exogenous transcription factors, endogenous transcription factors, or a combination thereof.

In some embodiments, the fusosome comprises (e.g., is capable of delivering to the target cell) a plurality of agents (e.g., at least 2, 3, 4, 5, 10, 20, or 50 agents), wherein each agent of the plurality acts on a step of a pathway in the target cell, e.g., wherein the pathway is a biosynthetic pathway, a catabolic pathway, or a signal transduction cascade. In embodiments, each agent in the plurality upregulates the pathway or downregulates the pathway. In some embodiments, the fusosome further comprises, or the method further comprises delivering, one more additional agents (e.g., comprises a second plurality of agents) that do not act on a step of the pathway, e.g., that act on a step of a second pathway. In some embodiments, the fusosome comprises (e.g., is capable of delivering to the target cell), or the method further comprises delivering, a plurality of agents (e.g., at least 2, 3, 4, 5, 10, 20, or 50 agents), wherein each agent of the plurality is part of a single pathway, e.g., wherein the pathway is a biosynthetic pathway, a catabolic pathway, or a signal transduction cascade. In some embodiments, the fusosome further comprises, or the method further comprises delivering, one more additional agents (e.g., comprises a second plurality of agents) that are not part of the single pathway, e.g., are part of a second pathway.

In some embodiments, the target cell comprises an aggregated or misfolded protein. In some embodiments, the fusosome is capable of reducing levels (e.g., reduces levels) of the aggregated or misfolded protein in the target cell, or a method herein comprises reducing levels of the aggregated or misfolded protein in the target cell.

In some embodiments, the agent is selected from a transcription factor, enzyme (e.g., nuclear enzyme or cytosolic enzyme), reagent that mediates a sequence specific modification to DNA (e.g., Cas9, ZFN, or TALEN), mRNA (e.g., mRNA encoding an intracellular protein), organelle, or metabolite.

In some embodiments, the fusosome is capable of delivering (e.g., delivers) an agent, e.g., a protein, to the cell membrane of a target cell. Similarly, in some embodiments, a method herein comprises delivering an agent to the cell membrane of a target cell. In some embodiments, delivering the protein comprises delivering a nucleic acid (e.g., mRNA) encoding the protein to the target cell such that the target cell produces the protein and localizes it to the membrane. In some embodiments, the fusosome comprises, or the method further comprises delivering, the protein, and fusion of the fusosome with the target cell transfers the protein to the cell membrane of the target cell. In some embodiments, the agent comprises a cell surface ligand or an antibody that binds a cell surface receptor. In some embodiments, the fusosome further comprises, or the method further comprises delivering, a second agent that comprises or encodes a second cell surface ligand or antibody that binds a cell surface receptor, and optionally further comprising or encoding one or more additional cell surface ligands or antibodies that bind a cell surface receptor (e.g., 1, 2, 3, 4, 5, 10, 20, 50, or more). In some embodiments, the first agent and the second agent form a complex, wherein optionally the complex further comprises one or more additional cell surface ligands. In some embodiments, the agent comprises or encodes a cell surface receptor, e.g., an exogenous cell surface receptor. In some embodiments, the fusosome further comprises, or the method further comprises delivering, a second agent that comprises or encodes a second cell surface receptor, and optionally further comprises or encodes one or more additional cell surface receptors (e.g., 1, 2, 3, 4, 5, 10, 20, 50, or more cell surface receptors).

In some embodiments, the first agent and the second agent form a complex, wherein optionally the complex further comprises one or more additional cell surface receptors. In some embodiments, the agent comprises or encodes an antigen or an antigen presenting protein.

In some embodiments, the fusosome is capable of delivering (e.g., delivers) a secreted agent, e.g., a secreted protein to a target site (e.g., an extracellular region), e.g., by delivering a nucleic acid (e.g., mRNA) encoding the protein to the target cell under conditions that allow the target cell to produce and secrete the protein. Similarly, in some embodiments, a method herein comprises delivering a secreted agent as described herein. In embodiments, the secreted protein is endogenous or exogenous. In embodiments, the secreted protein comprises a protein therapeutic, e.g., an antibody molecule, a cytokine, or an enzyme. In embodiments, the secreted protein comprises an autocrine signalling molecule or a paracrine signalling molecule. In embodiments, the secreted agent comprises a secretory granule.

In some embodiments, the fusosome is capable of reprogramming (e.g., reprograms) a target cell (e.g., an immune cell), e.g., by delivering an agent selected from a transcription factor or mRNA, or a plurality of said agents. Similarly, in some embodiments, a method herein comprises reprogramming a target cell. In embodiments, reprogramming comprises inducing a pancreatic endocrine cell to take on one or more characteristics of a pancreatic beta cell, by inducing a non-dopaminergic neuron to take on one or more characteristics of a dopaminergic neuron, or by inducing an exhausted T cell to take on one or more characteristics of a non-exhausted T cell, e.g., a killer T cell. In some embodiments, the agent comprises an antigen. In some embodiments, the fusosome comprises a first agent comprising an antigen and a second agent comprising an antigen presenting protein.

In some embodiments, the fusosome is capable of donating (e.g., donates) one or more cell surface receptors to a target cell (e.g., an immune cell). Similarly, in some embodiments, a method herein comprises donating one or more cell surface receptors.

In some embodiments, a fusosome is capable of modifying, e.g., modifies, a target tumor cell. Similarly, in some embodiments, a method herein comprises modifying a target tumor cell. In embodiments, the fusosome comprises an mRNA encoding an immunostimulatory ligand, an antigen presenting protein, a tumor suppressor protein, or a pro-apoptotic protein. In some embodiments, the fusosome comprises an miRNA capable of reducing levels in a target cell of an immunosuppressive ligand, a mitogenic signal, or a growth factor.

In some embodiments, a fusosome comprises an agent that is immunomodulatory, e.g., immunostimulatory.

In some embodiments, a fusosome is capable of causing (e.g., causes) the target cell to present an antigen. Similarly, in some embodiments, a method herein comprises presenting an antigen on a target cell.

In some embodiments, the fusosome promotes regeneration in a target tissue. Similarly, in some embodiments, a method herein comprises promoting regeneration in a target tissue. In embodiments, the target cell is a cardiac cell, e.g., a cardiomyocyte (e.g., a quiescent cardiomyocyte), a hepatoblast (e.g., a bile duct hepatoblast), an epithelial cell, a naïve T cell, a macrophage (e.g., a tumor infiltrating macrophage), or a fibroblast (e.g., a cardiac fibroblast). In embodiments, the source cell is a T cell (e.g., a Treg), a macrophage, or a cardiac myocyte.

In some embodiments, the fusosome is capable of delivering (e.g., delivers) a nucleic acid to a target cell, e.g., to stably modify the genome of the target cell, e.g., for gene therapy.

Similarly, in some embodiments, a method herein comprises delivering a nucleic acid to a target cell. In some embodiments, the target cell has an enzyme deficiency, e.g., comprises a mutation in an enzyme leading to reduced activity (e.g., no activity) of the enzyme.

In some embodiments, the fusosome is capable of delivering (e.g., delivers) a reagent that mediates a sequence specific modification to DNA (e.g., Cas9, ZFN, or TALEN) in the target cell. Similarly, in some embodiments, a method herein comprises delivering the reagent to the target cell. In embodiments, the target cell is a T cell.

In some embodiments, the fusosome is capable of delivering (e.g., delivers) a nucleic acid to a target cell, e.g., to transiently modify gene expression in the target cell.

In some embodiments, the fusosome is capable of delivering (e.g., delivers) a protein to a target cell, e.g., to transiently rescue a protein deficiency. Similarly, in some embodiments, a method herein comprises delivering a protein to a target cell. In embodiments, the protein is a membrane protein (e.g., a membrane transporter protein), a cytoplasmic protein (e.g., an enzyme), or a secreted protein (e.g., an immunosuppressive protein).

In some embodiments, the fusosome is capable of delivering (e.g., delivers) an organelle to a target cell, e.g., wherein the target cell has a defective organelle network. Similarly, in some embodiments, a method herein comprises delivering an organelle to a target cell. In embodiments, the source cell is a hepatocyte, skeletal muscle cell, or neuron.

In some embodiments, the fusosome is capable of delivering (e.g., delivers) a nucleus to a target cell, e.g., wherein the target cell has a genetic mutation. Similarly, in some embodiments, a method herein comprises delivering a nucleus to a target cell. In some embodiments, the nucleus is autologous and comprises one or more genetic changes relative to the target cell, e.g., it comprises a sequence specific modification to DNA (e.g., Cas9, ZFN, or TALEN), or an artificial chromosome, an additional genetic sequence integrated into the genome, a deletion, or any combination thereof. In embodiments, the source of the autologous nucleus is a stem cell, e.g., a hematopoietic stem cell. In embodiments, the target cell is a muscle cell (e.g., a skeletal muscle cell or cardiomyocyte), a hepatocyte, or a neuron.

In some embodiments, the fusosome is capable of intracellular molecular delivery, e.g., delivers a protein agent to a target cell. Similarly, in some embodiments, a method herein comprises delivering a molecule to an intracellular region of a target cell. In embodiments, the protein agent is an inhibitor. In embodiments, the protein agent comprises a nanobody, scFv, camelid antibody, peptide, macrocycle, or small molecule.

In some embodiments, the fusosome is capable of causing (e.g., causes) a target cell to secrete a protein, e.g., a therapeutic protein. Similarly, in some embodiments, a method herein comprises causing a target cell to secrete a protein.

In some embodiments, the fusosome is capable of secreting (e.g., secretes) an agent, e.g., a protein. In some embodiments, the agent, e.g., secreted agent, is delivered to a target site in a subject. In some embodiments, the agent is a protein that can not be made recombinantly or is difficult to make recombinantly. In some embodiments, the fusosome that secretes a protein is from a source cell selected from an MSC or a chondrocyte.

In some embodiments, the fusosome comprises on its membrane one or more cell surface ligands (e.g., 1, 2, 3, 4, 5, 10, 20, 50, or more cell surface ligands). Similarly, in some embodiments, a method herein comprises presenting one or more cell surface ligands to a target cell. In some embodiments, the fusosome having a cell surface ligand is from a source cell chosen from a neutrophil (e.g., and the target cell is a tumor-infiltrating lymphocyte), dendritic cell (e.g., and the target cell is a naïve T cell), or neutrophil (e.g., and the target is a tumor cell or virus-infected cell). In some embodiments the fusosome comprises a membrane complex, e.g., a complex comprising at least 2, 3, 4, or 5 proteins, e.g., a homodimer, heterodimer, homotrimer, heterotrimer, homotetramer, or heterotetramer. In some embodiments, the fusosome comprises an antibody, e.g., a toxic antibody, e.g., the fusosome is capable of delivering the antibody to the target site, e.g., by homing to a target site. In some embodiments, the source cell is an NK cell or neutrophil.

In some embodiments, a method herein comprises causing secretion of a protein from a target cell or ligand presentation on the surface of a target cell. In some embodiments, the fusosome is capable of causing cell death of the target cell. In some embodiments, the fusosome is from a NK source cell.

In some embodiments, a fusosome or target cell is capable of phagocytosis (e.g., of a pathogen). Similarly, in some embodiments, a method herein comprises causing phagocytosis.

In some embodiments, a fusosome senses and responds to its local environment. In some embodiments, the fusosome is capable of sensing level of a metabolite, interleukin, or antigen.

In embodiments, a fusosome is capable of chemotaxis, extravasation, or one or more metabolic activities. In embodiments, the metabolic activity is selected from kyneurinine, gluconeogenesis, prostaglandin fatty acid oxidation, adenosine metabolism, urea cycle, and thermogenic respiration. In some embodiments, the source cell is a neutrophil and the fusosome is capable of homing to a site of injury. In some embodiments, the source cell is a macrophage and the fusosome is capable of phagocytosis. In some embodiments, the source cell is a brown adipose tissue cell and the fusosome is capable of lipolysis.

In some embodiments, the fusosome comprises (e.g., is capable of delivering to the target cell) a plurality of agents (e.g., at least 2, 3, 4, 5, 10, 20, or 50 agents). In embodiments, the fusosome comprises an inhibitory nucleic acid (e.g., siRNA or miRNA) and an mRNA.

In some embodiments, the fusosome comprises (e.g., is capable of delivering to the target cell) a membrane protein or a nucleic acid encoding the membrane protein. In embodiments, the fusosome is capable of reprogramming or transdifferentiating a target cell, e.g., the fusosome comprises one or more agents that induce reprogramming or transdifferentiation of a target cell.

In some embodiments, the subject is in need of regeneration. In some embodiments, the subject suffers from cancer, an autoimmune disease, an infectious disease, a metabolic disease, a neurodegenerative disease, or a genetic disease (e.g., enzyme deficiency).

In some embodiments (e.g., embodiments for assaying non-endocytic delivery of cargo) cargo delivery is assayed using one or more of (e.g., all of) the following steps: (a) placing 30,000 HEK-293T target cells into a first well of a 96-well plate comprising 100 nM bafilomycin A1, and placing a similar number of similar cells into a second well of a 96-well plate lacking bafilomycin A1, (b) culturing the target cells for four hours in DMEM media at 37° C. and 5% $CO_2$, (c) contacting the target cells with 10 μg of fusosomes that comprise cargo, (d) incubating the target cells and fusosomes for 24 hrs at 37° C. and 5% $CO_2$, and (e) determining the percentage of cells in the first well and in the second well that comprise the cargo. Step (e) may comprise detecting the cargo using microscopy, e.g., using immunofluorescence. Step (e) may comprise detecting the cargo indirectly, e.g., detecting a downstream effect of the cargo, e.g., presence of a reporter protein. In some embodiments, one or more of steps (a)-(e) above is performed as described in Example 80.

In some embodiments, an inhibitor of endocytosis (e.g., chloroquine or bafilomycin A1) inhibits inhibits endosomal acidification. In some embodiments, cargo delivery is independent of lysosomal acidification. In some embodiments, an inhibitor of endocytosis (e.g., Dynasore) inhibits dynamin. In some embodiments, cargo delivery is independent of dynamin activity.

In some embodiments (e.g., embodiments for specific delivery of cargo to a target cell versus a non-target cell), cargo delivery is assayed using one or more of (e.g., all of) the following steps: (a) placing 30,000 HEK-293T target cells that over-express CD8a and CD8b into a first well of a 96-well plate and placing 30,000 HEK-293T non-target cells that do not over-express CD8a and CD8b into a second well of a 96-well plate, (b) culturing the cells for four hours in DMEM media at 37° C. and 5% $CO_2$, (c) contacting the target cells with 10 μg of fusosomes that comprise cargo, (d) incubating the target cells and fusosomes for 24 hrs at 37° C. and 5% $CO_2$, and (e) determining the percentage of cells in the first well and in the second well that comprise the cargo. Step (e) may comprise detecting the cargo using microscopy, e.g., using immunofluorescence. Step (e) may comprise detecting the cargo indirectly, e.g., detecting a downstream effect of the cargo, e.g., presence of a reporter protein. In some embodiments, one or more of steps (a)-(e) above is performed as described in Example 71.

In some embodiments, the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, 2-fold, 3-fold, 4-fold, 5-fold, 10-fold, 20-fold, 50-fold, or 100-fold, e.g., in an assay of Example 42 In some embodiments, the fusosome fuses at a higher rate with a target cell than with other fusosomes, e.g., by at least 10%, 20%, 30%, 40%, 50%, 60%, 70%, 80%, or 90%, e.g., in an assay of Example 42. In some embodiments, the fusosome fuses with target cells at a rate such that an agent in the fusosome is delivered to at least 10%, 20%, 30%, 40%, 50%, 60%, 70%, 80%, or 90%, of target cells after 24, 48, or 72 hours, e.g., in an assay of Example 42. In embodiments, the amount of targeted fusion is about 30%-70%, 35%-65%, 40%-60%, 45%-55%, or 45%-50%, e.g., about 48.8% e.g., in an assay of Example 42. In embodiments, the amount of targeted fusion is about 20%-40%, 25%-35%, or 30%-35%, e.g., about 32.2% e.g., in an assay of Example 43.

In some embodiments, the fusogen is present at a copy number of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 26. In some embodiments, at least 10%, 20%, 30%, 40%, 50%, 60%, 70%, 80%, 90%, 95%, 96%, 97%, 98%, or 99% of the fusogen comprised by the fusosome is disposed in the cell membrane. In embodiments, the fusosome also comprises fusogen internally, e.g., in the cytoplasm or an organelle. In some embodiments, the fusogen comprises (or is identified as comprising) about 0.1%, 0.2%, 0.3%, 0.4%, 0.5%, 0.6%, 0.7%, 0.8%, 0.9%, 1%, 5%, 10%, 11%, 12%, 13%, 14%, 15%, 20%, or more, or about 1-30%, 5-20%, 10-15%, 12-15%, 13-14%, or 13.6% of the total protein in a fusosome, e.g., as determined according to the method described in Example 94 and/or by a mass spectrometry assay. In embodiments, the fusogen comprises (or is identified as comprising) about 13.6% of the total protein in the fusosome. In some embodiments, the fusogen is (or is identified as being) more or less abundant than one or more additional proteins of interest, e.g., as determined according to the method described in Example 94. In an embodiment, the fusogen has (or is identified as having) a ratio to EGFP of about 140, 145, 150, 151, 152, 153, 154, 155, 156, 157 (e.g., 156.9), 158, 159, 160, 165, or 170. In another embodiment, the fusogen has (or is identified as having) a ratio to CD63 of about 2700, 2800, 2900, 2910 (e.g., 2912), 2920, 2930, 2940, 2950, 2960, 2970, 2980, 2990, or 3000, or about 1000-5000, 2000-4000, 2500-3500, 2900-2930, 2910-2915, or 2912.0, e.g., by a mass spectrometry assay. In an embodiment, the fusogen has (or is identified as having) a ratio to ARRDC1 of about 600, 610, 620, 630, 640, 650, 660 (e.g., 664.9), 670, 680, 690, or 700. In another embodiment, the fusogen has (or is identified as having) a ratio to GAPDH of about 50, 55, 60, 65, 70 (e.g., 69), 75, 80, or 85, or about 1-30%, 5-20%, 10-15%, 12-15%, 13-14%, or 13.6%. In another embodiment, the fusogen has (or is identified as having) a ratio to CNX of about 500, 510, 520, 530, 540, 550, 560 (e.g., 558.4), 570, 580, 590, or 600, or about 300-800, 400-700, 500-600, 520-590, 530-580, 540-570, 550-560, or 558.4, e.g., by a mass spectrometry assay.

In some embodiments, the fusosome comprises a therapeutic agent at a copy number of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 88. In some embodiments, the fusosome comprises a protein therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 88. In some embodiments, the fusosome comprises a nucleic acid therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the fusosome comprises a DNA therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the fusosome comprises an RNA therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the fusosome comprises an exogenous therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the fusosome comprises an exogenous protein therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the fusosome comprises an exogenous nucleic acid (e.g., DNA or RNA) therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies. In some embodiments, the ratio of the copy number of the fusogen to the copy number of the therapeutic agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000.

In some embodiments, the fusosome delivers to a target cell at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of a therapeutic agent. In some embodiments, the fusosome delivers to a target cell at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of a protein therapeutic agent. In some embodiments, the fusosome delivers to a target cell at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of a nucleic acid therapeutic agent. In some embodiments, the fusosome delivers to a target cell at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of an RNA therapeutic agent. In some embodiments, the fusosome delivers to a target cell at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of a DNA therapeutic agent.

In some embodiments, the fusosome delivers to a target cell at least 10%, 20%, 30%, 40%, 50%, 60%, 70%, 80%, 90%, 95%, 96%, 97%, 98%, or 99% of the cargo (e.g., a therapeutic agent, e.g., an endogenous therapeutic agent or an exogenous therapeutic agent) comprised by the fusosome. In some embodiments, the fusosomes that fuse with the target cell(s) deliver to the target cell an average of at least 10%, 20%, 30%, 40%, 50%, 60%, 70%, 80%, 90%, 95%, 96%, 97%, 98%, or 99% of the cargo (e.g., a therapeutic agent, e.g., an endogenous therapeutic agent or an exogenous therapeutic agent) comprised by the fusosomes that fuse with the target cell(s). In some embodiments, the fusosome composition delivers to a target tissue at least 10%, 20%, 30%, 40%, 50%, 60%, 70%, 80%, 90%, 95%, 96%, 97%, 98%, or 99% of the cargo (e.g., a therapeutic agent, e.g., an endogenous therapeutic agent or an exogenous therapeutic agent) comprised by the fusosome composition.

In some embodiments, the fusosome comprises 0.00000001 mg fusogen to 1 mg fusogen per mg of total protein in fusosome, e.g., 0.00000001-0.0000001, 0.0000001-0.000001, 0.000001-0.00001, 0.00001-0.0001, 0.0001-0.001, 0.001-0.01, 0.01-0.1, or 0.1-1 mg fusogen per mg of total protein in fusosome. In some embodiments, the fusosome comprises 0.00000001 mg fusogen to 5 mg fusogen per mg of lipid in fusosome, e.g., 0.00000001-0.0000001, 0.0000001-0.000001, 0.000001-0.00001, 0.00001-0.0001, 0.0001-0.001, 0.001-0.01, 0.01-0.1, 0.1-1, or 1-5 mg fusogen per mg of lipid in fusosome.

In some embodiments, the cargo is a protein cargo. In embodiments, the cargo is an endogenous or synthetic protein cargo. In some embodiments, the fusosomes have (or are identified as having) at least 1, 2, 3, 4, 5, 10, 20, 50, 100, or more protein cargo molecules per fusosome. In an embodiment, the fusosomes have (or are identified as having) about 100, 110, 120, 130, 140, 150, 160, 166, 170, 180, 190, or 200 protein agent molecules per fusosome, e.g., as quantified according to the method described in Example 88. In some embodiments, the endogenous or synthetic protein cargo comprises (or is identified as comprising) about 0.1%, 0.2%, 0.3%, 0.4%, 0.5%, 1%, 5%, 10%, 15%, 20%, 25% or more of the total protein in a fusosome. In an embodiment, the synthetic protein cargo comprises (or is identified as comprising) about 13.6% of the total protein in a fusosome. In some embodiments, the synthetic protein cargo has (or is identified as having) a ratio to VSV-G of about $4\times10^{-3}$, $5\times10^{-3}$, $6\times10^{-3}$ (e.g., $6.37\times10^{-3}$), $7\times10^{-3}$, or $8\times10^{-3}$. In embodiments, the synthetic protein cargo has (or is identified as having) a ratio to CD63 of about 10, 15, 16, 17, 18 (e.g., 18.6), 19, 20, 25, or 30, or about 10-30, 15-25, 16-19, 18-19, or 18.6. In embodiments, the synthetic protein cargo has (or is identified as having) a ratio to ARRDC1 of about 2, 3, 4 (e.g., 4.24), 5, 6, or 7. In embodiments, the synthetic protein cargo has (or is identified as having) a ratio to GAPDH of about 0.1, 0.2, 0.3, 0.4 (e.g., 0.44), 0.5, 0.6, or 0.7. In embodiments, the synthetic protein cargo has (or is identified as having) a ratio to CNX of about 1, 2, 3 (e.g., 3.56), 4, 5, or 6. In embodiments, the synthetic protein cargo has (or is identified as having) a ratio to TSG101 of about 10, 15, 16, 17, 18, 19 (e.g., 19.52), 20, 21, 22, 23, 24, 25, or 30.

In some embodiments, the fusogen comprises (or is identified as comprising) at least 0.5%, 1%, 5%, 10%, or more of the total protein in a fusosome, e.g., by a mass spectrometry assay. In an embodiment, the fusogen comprises (or is identified as comprising) about 1-30%, 5-20%, 10-15%, 12-15%, 13-14%, or 13.6% of the total protein in a fusosome, e.g., by a mass spectrometry assay. In some embodiments, the fusogen is more abundant than other proteins of interest. In embodiments, the fusogen has (or is identified as having) a ratio to a payload protein, e.g., EGFP, of about 145-170, 150-165, 155-160, 156.9, e.g., by a mass spectrometry assay. In embodiments, the fusogen has (or is identified as having) a ratio to CD63 of about 1000-5000, 2000-4000, 2500-3500, 2900-2930, 2910-2915, or 2912.0, e.g., by a mass spectrometry assay. In embodiments, the fusogen has a ratio to ARRDC1 of about 300-1000, 400-900, 500-800, 600-700, 640-690, 650-680, 660-670, or 664.9, e.g., by a mass spectrometry assay. In embodiments, the fusogen has (or is identified as having) a ratio to GAPDH of about 20-120, 40-100, 50-90, 60-80, 65-75, 68-70, or 69.0, e.g., by a mass spectrometry assay. In embodiments, the fusogen has a ratio to CNX of about 200-900, 300-800, 400-700, 500-600, 520-590, 530-580, 540-570, 550-560, or 558.4, e.g., by a mass spectrometry assay. In embodiments, the mass spectrometry essay is an assay of Example 94.

In some embodiments, the number of lipid species present in both of (e.g., shared between) the fusosomes and source cells is (or is identified as being) at least 300, 400, 500, 550, 560, or 569, or is between 500-700, 550-600, or 560-580, e.g., using a mass spectrometry assay. In embodiments, the number of lipid species present in fusosomes at a level at least 25% of the corresponding lipid level in the source cells (both normalized to total lipid levels within a sample) is (or is identified as being) at least 300, 400, 500, 530, 540, or 548, or is between 400-700, 500-600, 520-570, 530-560, or 540-550, e.g., using a mass spectrometry assay. In some embodiments, the fraction of lipid species present in both of (e.g., shared between) the fusosomes and source cells to total lipid species in the source cell is (or is identified as being) about 0.4-1.0, 0.5-0.9, 0.6-0.8, or 0.7, or at least 0.4, 0.5, 0.6, or 0.7, e.g., using a mass spectrometry assay. In some embodiments, the mass spectrometry assay is an assay of Example 86.

In some embodiments, the number of protein species present in both of (e.g., shared between) the fusosomes are source cells is (or is identified as being) at least 500, 1000, 1100, 1200, 1300, 1400, 1487, 1500, or 1600, or is (or is identified as being) between 1200-1700, 1300-1600, 1400-1500, 1450-1500, or 1480-1490, e.g., using a mass spectrometry assay. In embodiments, the number of protein species present in fusosomes at a level at least 25% of the corresponding protein level in the source cells (both normalized to total protein levels within a sample) is (or is identified as being) at least 500, 600, 700, 800, 900, 950, 957, 1000, or 1200, e.g., using a mass spectrometry assay. In some embodiments, the fraction of protein species present in both of (e.g., shared between) the fusosomes and source cells to total protein species in the source cell is (or is identified as being) about 0.1-0.6, 0.2-0.5, 0.3-0.4, or 0.333, or at least about 0.1, 0.2, 0.3, 0.333, or 0.4, e.g., using a mass spectrometry assay. In embodiments, the mass spectrometry assay is an assay of Example 87.

In some embodiments, CD63 is (or is identified as being) present at less than 0.048%, 0.05%, 0.1%, 0.5%, 1%, 2%, 3%, 4%, 5%, or 10% the amount of total protein in fusosomes, e.g., by a mass spectrometry assay, e.g., an assay of Example 89.

In some embodiments, the fusosomes are produced by extrusion through a filter, e.g., a filter of about 1-10, 2-8, 3-7, 4-6, or 5 μm. In some embodiments, the fusosomes have (or is identified as having) an average diameter of about 1-5, 2-5, 3-5, 4-5, or 5 μm. In some embodiments, the fusosomes have (or is identified as having) an average diameter of at least 1, 2, 3, 4, or 5 μm.

In some embodiments, the fusosomes are enriched for (or are identified as being enriched for) one or more of (e.g., at least 2, 3, 4, 5, or all of) the following lipids compared to the source cells: cholesteryl ester, free cholesterol, ether-linked lyso-phosphatidylethanolamine, lyso-phosphatidylserine, phosphatidate, ether-linked phosphatidylethanolamine, phosphatidylserine, and sphingomyelin. In some embodiments, the fusosomes are depleted for (or are identified as being depleted for) one or more of (e.g., at least 2, 3, 4, 5, or all of) the following lipids compared to the source cells: ceramide, cardiolipin, lyso-phosphatidylcholine, lyso-phosphatidylethanolamine, lyso-phosphatidylglycerol, lyso-phosphatidylinositol, ether-linked phosphatidylcholine, phosphatidylethanolamine, phosphatidylglycerol, phosphatidylinositol, and triacylglycerol. In some embodiments, the fusosomes are enriched for (or are identified as being enriched for) one or more of the aforementioned enriched lipids and depleted for one or more of the aforementioned depleted lipids. In some embodiments, the fusosomes comprise (or are identified as comprising) the enriched lipid as a percentage of total lipid that is at least 10%, 20%, 30%, 40%, 50%, 60%, 70%, 80%, 90%, 2-fold, 5-fold, or 10-fold greater than the corresponding level in source cells. In some embodiments, the fusosome comprise (or are identified as comprising) the depleted lipid as a percentage of total lipid at a level that is less than 90%, 80%, 70%, 60%, 50%, 40%, 30%, 20%, or 10% of the corresponding level in the source cells. In embodiments, lipid enrichment is measured by a mass spectrometry assay, e.g., an assay of Example 96.

In some embodiments, CE lipid levels are (or are identified as being) about 2-fold greater in fusosomes than in exosomes and/or about 5, 6, 7, 8, 9, or 10-fold higher in fusosomes than in parental cells (relative to total lipid in a sample). In some embodiments, ceramide lipid levels are (or are identified as being) about 2, 3, 4, or 5-fold greater in parental cells than in fusosomes (relative to total lipid in a sample). In some embodiments, cholesterol levels are (or are identified as being) about 1.1, 1.2, 1.3, 1.4, 1.5, 1.6, 1.7, 1.8, 1.9, or 2-fold greater in exosomes than in fusosomes and/or about 2-fold higher in fusosomes than in parental cells (relative to total lipid in a sample). In some embodiments, CL lipid levels are (or are identified as being) at least about 5, 10, 20, 30, or 40-fold greater in parental cells than in fusosomes (relative to total lipid in a sample). In some embodiments, DAG lipid levels are (or are identified as being) about 2 or 3-fold greater in exosomes than in fusosomes and/or about 1.5 or 2-fold higher in parental cells than in fusosomes (relative to total lipid in a sample). In some embodiments, PC lipid levels are (or are identified as being) about equal between exosomes and fusosomes and/or about 1.3, 1.4, 1.5, 1.6, 1.7, or 1.8-fold higher in parental cells than in fusosomes (relative to total lipid in a sample). In some embodiments, PC O-lipid levels are (or are identified as being) about equal between exosomes and fusosomes and/or about 2-fold higher in parental cells than in fusosomes (relative to total lipid in a sample). In some embodiments, PE lipid levels are (or are identified as being) about 1.3, 1.4, 1.5, 1.6, 1.7, or 1.8-fold higher in fusosomes than in exosomes and/or about 1.3, 1.4, 1.5, 1.6, 1.7, or 1.8-fold higher in parental cells than in fusosomes (relative to total lipid in a sample). In some embodiments, PE O-lipid levels are (or are identified as being) about equal between exosomes and fusosomes and/or about 1.5, 1.6, 1.7, 1.8, 1.9, or 2-fold higher in parental cells than in fusosomes (relative to total lipid in a sample). In some embodiments, PG lipid levels are (or are identified as being) about equal between exosomes and fusosomes and/or about 2, 3, 4, 5, 6, 7, 8, 9, or 10-fold higher in parental cells than in fusosomes (relative to total lipid in a sample). In some embodiments, PI lipid levels are (or are identified as being) about equal between exosomes and fusosomes and/or about 3, 4, 5, 6, or 7-fold higher in parental cells than in fusosomes (relative to total lipid in a sample). In some embodiments, PS lipid levels are (or are identified as being) (or are identified as being) about equal between exosomes and fusosomes and/or about 2-fold higher in fusosomes than in parental cells (relative to total lipid in a sample). In some embodiments, SM lipid levels are (or are identified as being) about equal between exosomes and fusosomes and/or about 2, 2.5, or 3-fold higher in fusosomes than in parental cells (relative to total lipid in a sample). In some embodiments, TAG lipid levels are (or are identified as being) about equal between exosomes and fusosomes and/or about 10, 20, 30, 40, 50, 60, 70 80, 90, 100-fold, or more higher in parental cells than in fusosomes (relative to total lipid in a sample).

In some embodiments, the fusosomes are (or are identified as being) enriched for one or more of (e.g., at least 2, 3, 4, 5, or all of) the following lipids compared to exosomes: cholesteryl ester, ceramide, diacylglycerol, lyso-phosphatidate, and phosphatidylethanolamine, and triacylglycerol. In some embodiments, the fusosomes are (or are identified as being) depleted for one or more of (e.g., at least 2, 3, 4, 5, or all of) the following lipids compared to exosomes (relative to total lipid in a sample): free cholesterol, hexosyl ceramide, lyso-phosphatidylcholine, ether-linked lyso-phosphatidylcholine, lyso-phosphatidylethanolamine, ether-linked lyso-phosphatidylethanolamine, and lyso-phosphatidylserine. In some embodiments, the fusosomes are (or are identified as being) enriched for one or more of the aforementioned enriched lipids and depleted for one or more of the aforementioned depleted lipids. In some embodiments, the fusosomes comprise (or are identified as comprising) the enriched lipid as a percentage of total lipid that is at least 10%, 20%, 30%, 40%, 50%, 60%, 70%, 80%, 90%, 2-fold, 5-fold, or 10-fold greater than the corresponding level in exosomes. In some embodiments, the fusosome comprise (or are identified as comprising) the depleted lipid as a percentage of total lipid at a level that is less than 90%, 80%, 70%, 60%, 50%, 40%, 30%, 20%, or 10% of the corresponding level in exosomes. In embodiments, lipid enrichment is measured by a mass spectrometry assay, e.g., an assay of Example 96.

In some embodiments, ceramide lipid levels are (or are identified as being) about 2-fold higher in fusosomes than in exosomes and/or about 2-fold higher in parental cells than in fusosomes (relative to total lipid in a sample). In some embodiments, HexCer lipid levels are (or are identified as being) about 1.5, 1.6, 1.7, 1.8, 1.9, or 2-fold higher in exosomes than in fusosomes and/or about equal in parental cells and fusosomes (relative to total lipid in a sample). In some embodiments, LPA lipid levels are (or are identified as being) about 3 or 4-fold higher in fusosomes than in exosomes and/or about 1.3, 1.4, 1.5, 1.6, 1.7, or 1.8-fold higher in fusosomes than in parental cells (relative to total lipid in a sample). In some embodiments, LPC lipid levels are (or are identified as being) about 2-fold higher in exosomes than in fusosomes and/or about 1.5, 1.6, 1.7, 1.8, 1.9, or 2-fold higher in parental cells than in fusosomes (relative to total lipid in a sample). In some embodiments, LPC O-lipid levels are (or are identified as being) about 3 or 4-fold higher in exosomes than in fusosomes and/or about equal between parental cells and fusosomes (relative to total lipid in a sample). In some embodiments, LPE lipid levels are (or are identified as being) about 1.5, 1.6, 1.7, 1.8, 1.9, or 2-fold higher in exosomes than in fusosomes and/or about 1.5, 1.6, 1.7, 1.8, 1.9, or 2-fold higher in parental cells than in fusosomes (relative to total lipid in a sample). In some embodiments, LPE O-lipid levels are (or are identified as being) about 2 or 3-fold higher in exosomes than in fusosomes and/or about equal between parental cells and fusosomes (relative to total lipid in a sample). In some embodiments, LPS lipid levels are (or are identified as being) about 3-fold higher in exosomes than in fusosomes (relative to total lipid in a sample). In some embodiments, PA lipid levels are (or are identified as being) about 1.5, 1.6, 1.7, 1.8, 1.9, or 2-fold higher in fusosomes than in exosomes and/or about 2-fold higher in fusosomes than in parental cells (relative to total lipid in a sample). In some embodiments, PG lipid levels are (or are identified as being) about equal between fusosomes and exosomes and/or about 10, 11, 12, 13, 14, or 15-fold higher in parental cells than in fusosomes (relative to total lipid in a sample).

In some embodiments, the fusosome comprises a lipid composition substantially similar to that of the source cell or wherein one or more of CL, Cer, DAG, HexCer, LPA, LPC, LPE, LPG, LPI, LPS, PA, PC, PE, PG, PI, PS, CE, SM and TAG is within 10%, 15%, 20%, 25%, 30%, 35%, 40%, 45%, or 50% of the corresponding lipid level in the source cell. In embodiments, the lipid composition of fusosomes is similar to the cells from which they are derived. In embodiments, fusosomes and parental cells have (or are identified as having) a similar lipid composition if greater than or equal to about 50%, 55%, 60%, 65%, 70%, 75%, 80%, 85%, or 90% of the lipid species identified in any replicate sample of the parental cells are present (or are identified as being present) in any replicate sample of the fusosomes, e.g., as determined according to Example 86. In embodiments, of identified lipids, the average level in the fusosome is greater than about 10%, 15%, 20%, 25%, 30%, 35%, or 40% of the corresponding average lipid species level in the parental cell (relative to total lipid in a sample). In an embodiment, the lipid composition of the fusosome is enriched and/or depleted for specific lipids relative to the parental cell (relative to total lipid in a sample).

In some embodiments, the lipid composition of the fusosome is (or is identified as bring) enriched and/or depleted for specific lipids relative to the parental cell, e.g., as determined according to the method described in Example 96.

In some embodiments, the fusosome has (or is identified as having) a ratio of phosphatidylserine to total lipids that is greater than that of the parental cell. In embodiments, the fusosome has (or is identified as having) a ratio of phosphatidylserine to total lipids of about 110%, 115%, 120%, 121%, 122%, 123%, 124%, 125%, 130%, 135%, 140%, or more relative to that of the parental cell. In some embodiments, the fusosome is (or is identified as being) enriched for cholesteryl ester, free cholesterol, ether-linked lyso-phosphatidylethanolamine, lyso-phosphatidylserine, phosphatidate, ether-linked phosphatidylethanolamine, phosphatidylserine, and/or sphingomyelin relative to the parental cell. In some embodiments, the fusosomes is (or is identified as being) depleted for ceramide, cardiolipin, lyso-phosphatidylcholine, lyso-phosphatidylethanolamine, lyso-phosphatidylglycerol, lyso-phosphatidylinositol, ether-linked phosphatidylcholine, phosphatidylethanolamine, phosphatidylglycerol, phosphatidylinositol, and/or triacylglycerol relative to the parental cell. In some embodiments, the fusosome is (or is identified as being) enriched for cholesteryl ester, ceramide, diacylglycerol, lyso-phosphatidate, phosphatidylethanolamine, and/or triacylglycerol relative to an exosome. In some embodiments, the fusosome is (or is identified as being) depleted for free cholesterol, hexosyl ceramide, lyso-phosphatidylcholine, ether-linked lyso-phosphatidylcholine, lyso-phosphatidylethanolamine, ether-linked lyso-phosphatidylethanolamine, and/or lyso-phosphatidylserine relative to an exosome.

In some embodiments, the fusosome has a ratio of cardiolipin: ceramide that is within 10%, 20%, 30%, 40%, or 50% of the ratio of cardiolipin: ceramide in the source cell; or has a ratio of cardiolipin: diacylglycerol that is within 10%, 20%, 30%, 40%, or 50% of the ratio of cardiolipin: diacylglycerol in the source cell; or has a ratio of cardiolipin: hexosylceramide that is within 10%, 20%, 30%, 40%, or 50% of the ratio of cardiolipin: hexosylceramide in the source cell; or has a ratio of cardiolipin: lysophosphatidate that is within 10%, 20%, 30%, 40%, or 50% of the ratio of cardiolipin: lysophosphatidate in the source cell; or has a ratio of cardiolipin: lyso-phosphatidylcholine that is within 10%, 20%, 30%, 40%, or 50% of the ratio of cardiolipin: lyso-phosphatidylcholine in the source cell; or has a ratio of cardiolipin: lyso-phosphatidylethanolamine that is within 10%, 20%, 30%, 40%, or 50% of the ratio of cardiolipin: lyso-phosphatidylethanolamine in the source cell; or has a ratio of cardiolipin: lyso-phosphatidylglycerol that is within 10%, 20%, 30%, 40%, or 50% of the ratio of cardiolipin: lyso-phosphatidylglycerol in the source cell; or has a ratio of cardiolipin: lyso-phosphatidylinositol that is within 10%, 20%, 30%, 40%, or 50% of the ratio of cardiolipin: lyso-phosphatidylinositol in the source cell; or has a ratio of cardiolipin: lyso-phosphatidylserine that is within 10%, 20%, 30%, 40%, or 50% of the ratio of cardiolipin: lyso-phosphatidylserine in the source cell; or has a ratio of cardiolipin: phosphatidate that is within 10%, 20%, 30%, 40%, or 50% of the ratio of cardiolipin: phosphatidate in the source cell; or has a ratio of cardiolipin: phosphatidylcholine that is within 10%, 20%, 30%, 40%, or 50% of the ratio of cardiolipin: phosphatidylcholine in the source cell; or has a ratio of cardiolipin: phosphatidylethanolamine that is within 10%, 20%, 30%, 40%, or 50% of the ratio of cardiolipin: phosphatidylethanolamine in the source cell; or has a ratio of cardiolipin: phosphatidylglycerol that is within 10%, 20%, 30%, 40%, or 50% of the ratio of cardiolipin: phosphatidylglycerol in the source cell; or has a ratio of cardiolipin: phosphatidylinositol that is within 10%, 20%, 30%, 40%, or 50% of the ratio of cardiolipin: phosphatidylinositol in the source cell; or has a ratio of cardiolipin: phosphatidylserine that is within 10%, 20%, 30%, 40%, or 50% of the ratio of cardiolipin: phosphatidylserine in the source cell; or has a ratio of cardiolipin: cholesterol ester that is within 10%, 20%, 30%, 40%, or 50% of the ratio of cardiolipin: cholesterol ester in the source cell; or has a ratio of cardiolipin: sphingomyelin that is within 10%, 20%, 30%, 40%, or 50% of the ratio of cardiolipin: sphingomyelin in the source cell; or has a ratio of cardiolipin: triacylglycerol that is within 10%, 20%, 30%, 40%, or 50% of the ratio of cardiolipin: triacylglycerol in the source cell; or has a ratio of phosphatidylcholine: ceramide that is within 10%, 20%, 30%, 40%, or 50% of the ratio of phosphatidylcholine: ceramide in the source cell; or has a ratio of phosphatidylcholine: diacylglycerol that is within 10%, 20%, 30%, 40%, or 50% of the ratio of phosphatidylcholine: diacylglycerol in the source cell; or has a ratio of phosphatidylcholine: hexosylceramide that is within 10%, 20%, 30%, 40%, or 50% of the ratio of phosphatidylcholine: hexosylceramide in the source cell; or has a ratio of phosphatidylcholine: lysophosphatidate that is within 10%, 20%, 30%, 40%, or 50% of the ratio of phosphatidylcholine: lysophosphatidate in the source cell; or has a ratio of phosphatidylcholine: lyso-phosphatidylcholine that is within 10%, 20%, 30%, 40%, or 50% of the ratio of phosphatidylcholine: lyso-phosphatidylcholine in the source cell; or has a ratio of phosphatidylcholine: lyso-phosphatidylethanolamine that is within 10%, 20%, 30%, 40%, or 50% of the ratio of phosphatidylcholine: lyso-phosphatidylethanolamine in the source cell; or has a ratio of phosphatidylcholine: lyso-phosphatidylglycerol that is within 10%, 20%, 30%, 40%, or 50% of the ratio of phosphatidylcholine: lyso-phosphatidylglycerol in the source cell; or has a ratio of phosphatidylcholine: lyso-phosphatidylinositol that is within 10%, 20%, 30%, 40%, or 50% of the ratio of phosphatidylcholine: lyso-phosphatidylinositol in the source cell; or has a ratio of phosphatidylcholine: lyso-phosphatidylserine that is within 10%, 20%, 30%, 40%, or 50% of the ratio of phosphatidylcholine: lyso-phosphatidylserine in the source cell; or has a ratio of phosphatidylcholine: phosphatidate that is within 10%, 20%, 30%, 40%, or 50% of the ratio of cardiolipin: phosphatidate in the source cell; or has a ratio of phosphatidylcholine: phosphatidylethanolamine that is within 10%, 20%, 30%, 40%, or 50% of the ratio of phosphatidylcholine: phosphatidylethanolamine in the source cell; or has a ratio of cardiolipin: phosphatidylglycerol that is within 10%, 20%, 30%, 40%, or 50% of the ratio of phosphatidylcholine: phosphatidylglycerol in the source cell; or has a ratio of phosphatidylcholine: phosphatidylinositol that is within 10%, 20%, 30%, 40%, or 50% of the ratio of phosphatidylcholine: phosphatidylinositol in the source cell; or has a ratio of phosphatidylcholine: phosphatidylserine that is within 10%, 20%, 30%, 40%, or 50% of the ratio of phosphatidylcholine: phosphatidylserine in the source cell; or has a ratio of phosphatidylcholine: cholesterol ester that is within 10%, 20%, 30%, 40%, or 50% of the ratio of phosphatidylcholine: cholesterol ester in the source cell; or has a ratio of phosphatidylcholine: sphingomyelin that is within 10%, 20%, 30%, 40%, or 50% of the ratio of phosphatidylcholine: sphingomyelin in the source cell; or has a ratio of phosphatidylcholine: triacylglycerol that is within 10%, 20%, 30%, 40%, or 50% of the ratio of phosphatidylcholine: triacylglycerol in the source cell; or has a ratio of phosphatidylethanolamine: ceramide that is within 10%, 20%, 30%, 40%, or 50% of the ratio of phosphatidylethanolamine: ceramide in the source cell; or has a ratio of phosphatidylethanolamine: diacylglycerol that is within 10%, 20%, 30%, 40%, or 50% of the ratio of phosphatidylethanolamine: diacylglycerol in the source cell; or has a ratio of phosphatidylethanolamine: hexosylceramide that is within 10%, 20%, 30%, 40%, or 50% of the ratio of phosphatidylethanolamine: hexosylceramide in the source cell; or has a ratio of phosphatidylethanolamine: lysophosphatidate that is within 10%, 20%, 30%, 40%, or 50% of the ratio of phosphatidylethanolamine: lysophosphatidate in the source cell; or has a ratio of phosphatidylethanolamine: lyso-phosphatidylcholine that is within 10%, 20%, 30%, 40%, or 50% of the ratio of phosphatidylethanolamine: lyso-phosphatidylcholine in the source cell; or has a ratio of phosphatidylethanolamine: lyso-phosphatidylethanolamine that is within 10%, 20%, 30%, 40%, or 50% of the ratio of phosphatidylethanolamine: lyso-phosphatidylethanolamine in the source cell; or has a ratio of phosphatidylethanolamine: lyso-phosphatidylglycerol that is within 10%, 20%, 30%, 40%, or 50% of the ratio of phosphatidylethanolamine: lyso-phosphatidylglycerol in the source cell; or has a ratio of phosphatidylethanolamine: lyso-phosphatidylinositol that is within 10%, 20%, 30%, 40%, or 50% of the ratio of phosphatidylethanolamine: lyso-phosphatidylinositol in the source cell; or has a ratio of phosphatidylethanolamine: lyso-phosphatidylserine that is within 10%, 20%, 30%, 40%, or 50% of the ratio of phosphatidylethanolamine: lyso-phosphatidylserine in the source cell; or has a ratio of phosphatidylethanolamine: phosphatidate that is within 10%, 20%, 30%, 40%, or 50% of the ratio of phosphatidylethanolamine: phosphatidate in the source cell; or has a ratio of phosphatidylethanolamine: phosphatidylglycerol that is within 10%, 20%, 30%, 40%, or 50% of the ratio of phosphatidylethanolamine: phosphatidylglycerol in the source cell; or has a ratio of phosphatidylethanolamine: phosphatidylinositol that is within 10%, 20%, 30%, 40%, or 50% of the ratio of phosphatidylethanolamine: phosphatidylinositol in the source cell; or has a ratio of phosphatidylethanolamine: phosphatidylserine that is within 10%, 20%, 30%, 40%, or 50% of the ratio of phosphatidylethanolamine: phosphatidylserine in the source cell; or has a ratio of phosphatidylethanolamine: cholesterol ester that is within 10%, 20%, 30%, 40%, or 50% of the ratio of phosphatidylethanolamine: cholesterol ester in the source cell; or has a ratio of phosphatidylethanolamine: sphingomyelin that is within 10%, 20%, 30%, 40%, or 50% of the ratio of phosphatidylethanolamine: sphingomyelin in the source cell; or has a ratio of phosphatidylethanolamine: triacylglycerol that is within 10%, 20%, 30%, 40%, or 50% of the ratio of phosphatidylethanolamine: triacylglycerol in the source cell; or has a ratio of phosphatidylserine: ceramide that is within 10%, 20%, 30%, 40%, or 50% of the ratio of phosphatidylserine: ceramide in the source cell; or has a ratio of phosphatidylserine: diacylglycerol that is within 10%, 20%, 30%, 40%, or 50% of the ratio of phosphatidylserine: diacylglycerol in the source cell; or has a ratio of phosphatidylserine: hexosylceramide that is within 10%, 20%, 30%, 40%, or 50% of the ratio of phosphatidylserine: hexosylceramide in the source cell; or has a ratio of phosphatidylserine: lysophosphatidate that is within 10%, 20%, 30%, 40%, or 50% of the ratio of phosphatidylserine: lysophosphatidate in the source cell; or has a ratio of phosphatidylserine: lyso-phosphatidylcholine that is within 10%, 20%, 30%, 40%, or 50% of the ratio of phosphatidylserine: lyso-phosphatidylcholine in the source cell; or has a ratio of phosphatidylserine: lyso-phosphatidylethanolamine that is within 10%, 20%, 30%, 40%, or 50% of the ratio of phosphatidylserine: lyso-phosphatidylethanolamine in the source cell; or has a ratio of phosphatidylserine: lyso-phosphatidylglycerol that is within 10%, 20%, 30%, 40%, or 50% of the ratio of phosphatidylserine: lyso-phosphatidylglycerol in the source cell; or has a ratio of phosphatidylserine: lyso-phosphatidylinositol that is within 10%, 20%, 30%, 40%, or 50% of the ratio of phosphatidylserine: lyso-phosphatidylinositol in the source cell; or has a ratio of phosphatidylserine: lyso-phosphatidylserine that is within 10%, 20%, 30%, 40%, or 50% of the ratio of phosphatidylserine: lyso-phosphatidylserine in the source cell; or has a ratio of phosphatidylserine: phosphatidate that is within 10%, 20%, 30%, 40%, or 50% of the ratio of phosphatidylserine: phosphatidate in the source cell; or has a ratio of phosphatidylserine: phosphatidylglycerol that is within 10%, 20%, 30%, 40%, or 50% of the ratio of phosphatidylserine: phosphatidylglycerol in the source cell; or has a ratio of phosphatidylserine: phosphatidylinositol that is within 10%, 20%, 30%, 40%, or 50% of the ratio of phosphatidylserine: phosphatidylinositol in the source cell; or has a ratio of phosphatidylserine: cholesterol ester that is within 10%, 20%, 30%, 40%, or 50% of the ratio of phosphatidylserine: cholesterol ester in the source cell; or has a ratio of phosphatidylserine: sphingomyelin that is within 10%, 20%, 30%, 40%, or 50% of the ratio of phosphatidylserine: sphingomyelin in the source cell; or has a ratio of phosphatidylserine: triacylglycerol that is within 10%, 20%, 30%, 40%, or 50% of the ratio of phosphatidylserine: triacylglycerol in the source cell; or has a ratio of sphingomyelin: ceramide that is within 10%, 20%, 30%, 40%, or 50% of the ratio of sphingomyelin: ceramide in the source cell; or has a ratio of sphingomyelin: diacylglycerol that is within 10%, 20%, 30%, 40%, or 50% of the ratio of sphingomyelin: diacylglycerol in the source cell; or has a ratio of sphingomyelin: hexosylceramide that is within 10%, 20%, 30%, 40%, or 50% of the ratio of sphingomyelin: hexosylceramide in the source cell; or has a ratio of sphingomyelin: lysophosphatidate that is within 10%, 20%, 30%, 40%, or 50% of the ratio of sphingomyelin: lysophosphatidate in the source cell; or has a ratio of sphingomyelin: lyso-phosphatidylcholine that is within 10%, 20%, 30%, 40%, or 50% of the ratio of sphingomyelin: lyso-phosphatidylcholine in the source cell; or has a ratio of sphingomyelin: lyso-phosphatidylethanolamine that is within 10%, 20%, 30%, 40%, or 50% of the ratio of sphingomyelin: lyso-phosphatidylethanolamine in the source cell; or has a ratio of sphingomyelin: lyso-phosphatidylglycerol that is within 10%, 20%, 30%, 40%, or 50% of the ratio of sphingomyelin: lyso-phosphatidylglycerol in the source cell; or has a ratio of sphingomyelin: lyso-phosphatidylinositol that is within 10%, 20%, 30%, 40%, or 50% of the ratio of sphingomyelin: lyso-phosphatidylinositol in the source cell; or has a ratio of sphingomyelin: lyso-phosphatidylserine that is within 10%, 20%, 30%, 40%, or 50% of the ratio of sphingomyelin: lyso-phosphatidylserine in the source cell; or has a ratio of sphingomyelin: phosphatidate that is within 10%, 20%, 30%, 40%, or 50% of the ratio of sphingomyelin: phosphatidate in the source cell; or has a ratio of sphingomyelin: phosphatidylglycerol that is within 10%, 20%, 30%, 40%, or 50% of the ratio of sphingomyelin: phosphatidylglycerol in the source cell; or has a ratio of sphingomyelin: phosphatidylinositol that is within 10%, 20%, 30%, 40%, or 50% of the ratio of sphingomyelin: phosphatidylinositol in the source cell; or has a ratio of sphingomyelin: cholesterol ester that is within 10%, 20%, 30%, 40%, or 50% of the ratio of sphingomyelin: cholesterol ester in the source cell; or has a ratio of sphingomyelin: triacylglycerol that is within 10%, 20%, 30%, 40%, or 50% of the ratio of sphingomyelin: triacylglycerol in the source cell; or has a ratio of cholesterol ester: ceramide that is within 10%, 20%, 30%, 40%, or 50% of the ratio of cholesterol ester: ceramide in the source cell; or has a ratio of cholesterol ester: diacylglycerol that is within 10%, 20%, 30%, 40%, or 50% of the ratio of cholesterol ester: diacylglycerol in the source cell; or has a ratio of cholesterol ester: hexosylceramide that is within 10%, 20%, 30%, 40%, or 50% of the ratio of cholesterol ester: hexosylceramide in the source cell; or has a ratio of cholesterol ester: lysophosphatidate that is within 10%, 20%, 30%, 40%, or 50% of the ratio of cholesterol ester: lysophosphatidate in the source cell; or has a ratio of cholesterol ester: lyso-phosphatidylcholine that is within 10%, 20%, 30%, 40%, or 50% of the ratio of cholesterol ester: lyso-phosphatidylcholine in the source cell; or has a ratio of cholesterol ester: lyso-phosphatidylethanolamine that is within 10%, 20%, 30%, 40%, or 50% of the ratio of cholesterol ester: lyso-phosphatidylethanolamine in the source cell; or has a ratio of cholesterol ester: lyso-phosphatidylglycerol that is within 10%, 20%, 30%, 40%, or 50% of the ratio of cholesterol ester: lyso-phosphatidylglycerol in the source cell; or has a ratio of cholesterol ester: lyso-phosphatidylinositol that is within 10%, 20%, 30%, 40%, or 50% of the ratio of cholesterol ester: lyso-phosphatidylinositol in the source cell; or has a ratio of cholesterol ester: lyso-phosphatidylserine that is within 10%, 20%, 30%, 40%, or 50% of the ratio of cholesterol ester: lyso-phosphatidylserine in the source cell; or has a ratio of cholesterol ester: phosphatidate that is within 10%, 20%, 30%, 40%, or 50% of the ratio of cholesterol ester: phosphatidate in the source cell; or has a ratio of cholesterol ester: phosphatidylglycerol that is within 10%, 20%, 30%, 40%, or 50% of the ratio of cholesterol ester: phosphatidylglycerol in the source cell; or has a ratio of cholesterol ester: phosphatidylinositol that is within 10%, 20%, 30%, 40%, or 50% of the ratio of cholesterol ester: phosphatidylinositol in the source cell; or has a ratio of cholesterol ester: triacylglycerol that is within 10%, 20%, 30%, 40%, or 50% of the ratio of cholesterol ester: triacylglycerol in the source cell.

In some embodiments, the fusosome comprises a proteomic composition similar to that of the source cell, e.g., using an assay of Example 87. In some embodiments, the protein composition of fusosomes are similar to the parental cells from which they are derived. In some embodiments, the fractional content of each of a plurality of categories of proteins is determined as the sum of intensity signals from each category divided by the sum of the intensity signals of all identified proteins in the sample, e.g., as described in Example 87. In some embodiments, the fusosome comprises (or is identified as comprising) varying amounts of compartment-specific proteins relative to parental cells and/or exosomes, e.g., as determined according to the method described in Example 97. In some embodiments, fusosomes are (or are identified as being) depleted with endoplasmic reticulum protein compared to parental cells and exosomes. In some embodiments, fusosomes are (or are identified as being) depleted for exosomal protein compared to exosomes. In some embodiments, fusosomes have (or are identified as having) less than 15%, 20%, or 25% of the protein in the fusosome as being exosomal protein. In some embodiments, fusosomes are (or are identified as being) depleted for mitochondrial protein compared to parental cells. In some embodiments, fusosomes are (or are identified as being) enriched for nuclear protein compared to parental cells. In some embodiments, fusosomes are (or are identified as being) enriched for ribosomal proteins compared to parental cells and exosomes. In some embodiments, at least 0.025%, 0.03%, 0.04%, 0.05%, 0.06%, 0.07%, 0.08%, 0.09%, 0.1%, 1%, 2%, 3%, 4%, 5%, 6%, 7% 8%, 9% or 10% of the protein in the fusosome is ribosomal protein, or about 0.025-0.2%, 0.05-0.15%, 0.06-1.4%, 0.07%-1.3%, 0.08%-1.2%, 0.09%-1.1%, 1%-20%, 3%-15%, 5%-12.5%, 7.5%-11%, or 8.5%-10.5%, or 9%-10% of the protein in the fusosome is ribosomal protein.

In some embodiments, the fusosome comprises a ratio of lipids to proteins that is within 10%, 20%, 30%, 40%, or 50% of the corresponding ratio in the source cell, e.g., as measured using an assay of Example 40. In embodiments, the fusosome comprises (or is identified as comprising) a ratio of lipid mass to proteins approximately equal to the lipid mass to protein ratio for nucleated cells. In embodiments, the fusosome comprises (or is identified as comprising) a greater lipid: protein ratio than the parental cell. In embodiments, the fusosome comprises (or is identified as comprising) a lipid: protein ratio of about 110%, 115%, 120%, 125%, 130%, 131%, 132%, 132.5%, 133%, 134%, 135%, 140%, 145%, or 150% of the lipid: protein ratio of the parental cell. In some embodiments, the fusosome or fusosome composition has (or is identified as having) a phospholipid: protein ratio of about 100-180, 110-170, 120-160, 130-150, 135-145, 140-142, or 141 μmol/g, e.g., in an assay of Example 83. In some embodiments, the fusosome or fusosome composition has (or is identified as having) a phospholipid: protein ratio that is about 60-90%, 70-80%, or 75% of the corresponding ratio in the source cells, e.g., in an assay of Example 83.

In some embodiments, the fusosome comprises a ratio of proteins to nucleic acids (e.g., DNA or RNA) that is within 10%, 20%, 30%, 40%, or 50% of the corresponding ratio in the source cell, e.g., as measured using an assay of Example 41. In embodiments, the fusosome comprises (or is identified as comprising) a ratio of protein mass to DNA mass similar to that of a parental cell. In embodiments, the fusosome comprises (or is identified as comprising) a ratio of protein: DNA that is about about 85%, 90%, 95%, 96%, 97%, 98%, 98.2%, 99%, 100%, 101%, 102%, 103%, 104%, 105%, or 110% of the parental cell. In some embodiments, the fusosome comprises a ratio of proteins to DNA that is greater than the corresponding ratio in the source cell, e.g., at least 10%, 20%, 30%, 40%, 50%, 60%, 70%, 80%, or 90% greater, e.g., as measured using an assay of Example 41. In some embodiments, the fusosome or fusosome composition comprises (or is identified as comprising) a ratio of protein: DNA that is about 20-35, 25-30, 26-29, 27-28, or 27.8 g/g, e.g., by an assay of Example 84. In some embodiments, the fusosome or fusosome composition comprises (or is identified as comprising) a ratio of protein: DNA that is within about 1%, 2%, 5%, 10%, or 20% of the corresponding ratio in the source cells, e.g., by an assay of Example 84.

In some embodiments, the fusosome comprises a ratio of lipids to nucleic acids (e.g., DNA) that is within 10%, 20%, 30%, 40%, or 50% of the corresponding ratio in the source cell, e.g., as measured using an assay of Example 91. In some embodiments, the fusosome or fusosome composition comprises (or is identified as comprising) a ratio of lipids: DNA that is about 2.0-6.0, 3.0-5.0, 3.5-4.5, 3.8-4.0, or 3.92 μmol/mg, e.g., by an assay of Example 85. In some embodiments, the fusosome comprises a ratio of lipids to nucleic acids (e.g., DNA) that is greater than the corresponding ratio in the source cell, e.g., at least 10%, 20%, 30%, 40%, 50%, 60%, 70%, 80%, or 90% greater, e.g., as measured using an assay of Example 91. In embodiments, the fusosome comprises (or is identified as comprising) a greater lipid: DNA ratio than the parental cell. In embodiments, the fusosome comprises about a 105%, 110%, 115%, 120%, 125%, 130%, 135%, 140%, 145%, 150%, or greater lipid: DNA ratio compared to the parental cell.

In some embodiments, the fusosome composition has a half-life in a subject, e.g., in a mouse, that is within 1%, 2%, 3%, 4%, 5%, 10%, 20%, 30%, 40%, 50%, 60%, 70%, 80%, 90%, 100% of the half life of a reference cell composition, e.g., the source cell, e.g., by an assay of Example 60. In some embodiments, the fusosome composition has a half-life in a subject, e.g., in a mouse, that is at least 1 hour, 2 hours, 3 hours, 4 hours, 5 hours, 6 hours, 12 hours, or 24 hours, e.g., in a human subject or in a mouse, e.g., by an assay of Example 60. In embodiments, the fusosome composition has a half-life of at least 1, 2, 4, 6, 12, or 24 hours in a subject, e.g., in an assay of Example 79. In some embodiments, the therapeutic agent has a half-life in a subject that is longer than the half-life of the fusosome composition, e.g., by at least 10%, 20%, 50%, 2-fold, 5-fold, or 10-fold. For instance, the fusosome may deliver the therapeutic agent to the target cell, and the therapeutic agent may be present after the fusosome is no longer present or detectable.

In some embodiments, the fusosome transports glucose (e.g., labeled glucose, e.g., 2-NBDG) across a membrane, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of glucose, e.g., as measured using an assay of Example 50. In some embodiments, the fusosome transports (or is identified as transporting) glucose (e.g., labeled glucose, e.g., 2-NBDG) across a membrane at a greater level than otherwise similar fusosomes treated with phloretin, e.g., in an assay of Example 72. In embodiments, a fusosome not treated with phloretin transports (or is identified as not transporting) glucose at a level at least 1%, 2%, 3%, 5%, or 10% higher (and optionally up to 15% higher) than an otherwise similar fusosome treated with phloretin, e.g., in an assay of Example 72. In some embodiments, the fusosome comprises esterase activity in the lumen that is within 1%, 2%, 3%, 4%, 5%, 10%, 20%, 30%, 40%, 50%, 60%, 70%, 80%, 90%, or 100% of that of the esterase activity in a reference cell, e.g., the source cell or a mouse embryonic fibroblast, e.g., using an assay of Example 51. In some embodiments, the fusosome comprises (or is identified as comprising) esterase activity in the lumen that is at least 10-fold, 20-fold, 50-fold, 100-fold, 200-fold, 500-fold, 1000-fold, 2000-fold, or 5000-fold higher than an unstained control, e.g., by an assay of Example 73. In some embodiments, the fusosome comprises (or is identified as comprising) esterase activity in the lumen that is about 10-100-fold lower than that of the source cells, e.g., by an assay of Example 73. In some embodiments, the fusosome comprises (or is identified as comprising) an acetylcholinesterase activity of about 1E5-1E6, 6E5-8E5, 6.5E5-7E5, or 6.83E5 exosome equivalents, e.g., by an assay of Example 74. In some embodiments, the fusosome comprises a metabolic activity level (e.g., citrate synthase activity) that is within 1%, 2%, 3%, 4%, 5%, 10%, 20%, 30%, 40%, 50%, 60%, 70%, 80%, 90%, or 100% of the metabolic activity level in a reference cell, e.g., the source cell, e.g., as described in Example 53. In some embodiments, the fusosome comprises a metabolic activity level (e.g., citrate synthase activity) that is at least 1%, 2%, 3%, 4%, 5%, 10%, 20%, 30%, 40%, 50%, 60%, 70%, 80%, 90%, or 100% of the metabolic activity level in a reference cell, e.g., the source cell, e.g., as described in Example 53. In some embodiments, the fusosome comprises (or is identified as comprising) a citrate synthase activity that is about 1E-2-2 E-2, 1.3E-2-1.8E-2, 1.4E-2-1.7E-2, 1.5E-2-1.6E-2, or 1.57E-2 μmol/ug fusosome/min, e.g., by an assay of Example 75. In some embodiments, the fusosome comprises a respiration level (e.g., oxygen consumption rate), e.g., basal, uncoupled, or maximal respiration level, that is within 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 54. In some embodiments, the fusosome comprises a respiration level (e.g., oxygen consumption rate), e.g., basal, uncoupled, or maximal respiration level, that is at least 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 54. In embodiments, the fusosome comprises (or is identified as comprising) a basal respiration rate of about 8-15, 9-14, 10-13, 11-12, or 11.3 μmol/min/20 ug fusosome, e.g., by an assay of Example 76. In embodiments, the fusosome comprises (or is identified as comprising) an uncoupled respiration rate of about 8-13, 9-12, 10-11, 10-10.2, or 10.1 μmol/min/20 ug fusosome, e.g., by an assay of Example 76. In embodiments, the fusosome comprises (or is identified as comprising) a maximal respiration rate of about 15-25, 16-24, 17-23, 18-22, 19-21, or 20 μmol/min/20 ug fusosome, e.g., by an assay of Example 76. In embodiments, the fusosome has (or is identified as having) a higher basal respiration rate than uncoupled respiration rate, e.g., by about 1%, 2%, 5%, or 10%, e.g., up to about 15%, e.g., by an assay of Example 76. In embodiments, the fusosome has (or is identified as having) a higher maximal respiration rate than basal respiration rate, e.g., by about 1%, 2%, 5%, 10%, 20%, 30%, 40%, 50%, 60%, 70%, 80%, or 90%, e.g., by an assay of Example 76. In some embodiments, the fusosome comprises an Annexin-V staining level of at most 18,000, 17,000, 16,000, 15,000, 14,000, 13,000, 12,000, 11,000, or 10,000 MFI, e.g., using an assay of Example 55, or wherein the fusosome comprises an Annexin-V staining level at least 5%, 10%, 20%, 30%, 40%, 50%, 60%, 70%, 80%, or 90% lower than the Annexin-V staining level of an otherwise similar fusosome treated with menadione in the assay of Example 55, or wherein the fusosome comprises an Annexin-V staining level at least 5%, 10%, 20%, 30%, 40%, 50%, 60%, 70%, 80%, or 90% lower than the Annexin-V staining level of a macrophage treated with menadione in the assay of Example 55. In embodiments, the fusosome comprises (or is identified as comprising) an Annexin V-staining level that is at least about 1%, 2%, 5%, or 10% lower than the Annexin V-staining level of an otherwise similar fusosome treated with antimycin A, e.g., in an assay of Example 77. In embodiments, the fusosome comprises (or is identified as comprising) an Annexin V-staining level that is within about 1%, 2%, 5%, or 10% of the Annexin V-staining level of an otherwise similar fusosome treated with antimycin A, e.g., in an assay of Example 77.

In some embodiments, the fusosome has a miRNA content level of at least at least 1%, 2%, 3%, 4%, 5%, 10%, 20%, 30%, 40%, 50%, 60%, 70%, 80%, 90%, or greater than that of the source cell, e.g., by an assay of Example 33. In some embodiments, the fusosome has a miRNA content level of at least 1%, 2%, 3%, 4%, 5%, 10%, 20%, 30%, 40%, 50%, 60%, 70%, 80%, 90%, or greater of the miRNA content level of the source cell (e.g., up to 100% of the miRNA content level of the source cell), e.g., by an assay of Example 33. In some embodiments, the fusosome has a total RNA content level of at least 1%, 2%, 3%, 4%, 5%, 10%, 20%, 30%, 40%, 50%, 60%, 70%, 80%, 90%, or greater of the total RNA content level of the source cell (e.g., up to 100% of the total RNA content level of the source cell), e.g., as measured by an assay of Example 66.

In some embodiments, the fusosome has a soluble: non-soluble protein ratio is within 1%, 2%, 3%, 4%, 5%, 10%, 20%, 30%, 40%, 50%, 60%, 70%, 80%, 90%, or greater than that of the source cell, e.g., within 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of that of the source cell, e.g., by an assay of Example 38. In embodiments, the fusosome has a soluble: non-soluble protein ratio of about 0.3-0.8, 0.4-0.7, or 0.5-0.6, e.g., about 0.563, e.g., by an assay of Example 38. In some embodiments, the population of fusosomes has (or is identified as having) a soluble: insoluble protein mass ratio of about 0.3-0.8, 0.4-0.7, 0.5-0.6, or 0.563, or greater than about 0.1, 0.2, 0.3, 0.4, or 0.5. In some embodiments, the population of fusosomes has (or is identified as having) a soluble: insoluble protein mass ratio that is greater than that of the source cells, e.g., at least 2-fold, 3-fold, 4-fold, 5-fold, 10-fold, or 20-fold higher. In embodiments, the soluble: insoluble protein mass ratio is determined by an assay of Example 70. In embodiments, the soluble: insoluble protein mass ratio is (or is identified as being) lower in the fusosome population than in the parental cells. In embodiments, when the ratio of fusosomes to parental cells is (or is identified as being) about 3%, 4%, 5%, 6%, 7%, or 8%, the soluble: insoluble ratio of the population of fusosomes is (or is identified as being) about equal to the soluble: insoluble ratio of the parental cells.

In some embodiments, the fusosome has an LPS level less than 5%, 1%, 0.5%, 0.01%, 0.005%, 0.0001%, 0.00001% or less of the LPS content of the source cell, e.g., as measured by mass spectrometry, e.g., in an assay of Example 39. In some embodiments, the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of insulin, e.g., using an assay of Example 49. In some embodiments, the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, 0.5%, 1%, 1.5%, 2%, 2.5%, 3%, 4%, 5%, 10%, 15%, 20%, 25%, 30%, 35%, 40%, 50%, 60%, 70%, 80%, or 90% of the fusosomes in a population of administered fusosomes are present in the target tissue after 24, 48, or 72 hours, e.g., by an assay of Example 64. In some embodiments, the fusosome has a juxtacrine-signaling level of at least 1%, 2%, 3%, 4%, 5%, 10%, 20%, 30%, 40%, 50%, 60%, 70%, 80%, 90%, or 100% greater than the level of juxtacrine signaling induced by a reference cell, e.g., the source cell or a bone marrow stromal cell (BMSC), e.g., by an assay of Example 56. In some embodiments, the fusosome has a juxtacrine-signaling level of at least 1%, 2%, 3%, 4%, 5%, 10%, 20%, 30%, 40%, 50%, 60%, 70%, 80%, or 90% (e.g., up to 100%) of the level of juxtacrine signaling induced by a reference cell, e.g., the source cell or a bone marrow stromal cell (BMSC), e.g., by an assay of Example 56. In some embodiments, the fusosome has a paracrine-signaling level of at least 1%, 2%, 3%, 4%, 5%, 10%, 20%, 30%, 40%, 50%, 60%, 70%, 80%, 90%, 100% greater than the level of paracrine signaling induced by a reference cell, e.g., the source cell or a macrophage, e.g., by an assay of Example 57. In some embodiments, the fusosome has a paracrine-signaling level of at least 1%, 2%, 3%, 4%, 5%, 10%, 20%, 30%, 40%, 50%, 60%, 70%, 80%, or 90% (e.g., up to 100%) of the level of paracrine signaling induced by a reference cell, e.g., the source cell or a macrophage, e.g., by an assay of Example 57. In some embodiments, the fusosome polymerizes actin at a level within 1%, 2%, 3%, 4%, 5%, 10%, 20%, 30%, 40%, 50%, 60%, 70%, 80%, 90%, or 100% compared to the level of polymerized actin in a reference cell, e.g., the source cell or a C2C12 cell, e.g., by the assay of Example 58. In some embodiments, the fusosome polymerizes actin (or is identified as polymerizing actin) at a level that is constant over time, e.g, over at least 3, 5, or 24 hours, e.g., by an assay of Example 81. In embodiments, the level of actin polymerization changes by less than 1%, 2%, 5%, 10%, or 20% over a 5-hour period, e.g. by the assay of Example 81. In some embodiments, the fusosome has a membrane potential within about 1%, 2%, 3%, 4%, 5%, 10%, 20%, 30%, 40%, 50%, 60%, 70%, 80%, 90%, 100% of the membrane potential of a reference cell, e.g., the source cell or a C2C12 cell, e.g., by an assay of Example 59, or wherein the fusosome has a membrane potential of about −20 to −150 mV, −20 to −50 mV, −50 to −100 mV, or −100 to −150 mV, or wherein the fusosome has a membrane potential of less than −1 mv, −5 mv, −10 mv, −20 mv, −30 mv, −40 mv, −50 mv, −60 mv, −70 mv, −80 mv, −90 mv, −100 mv. In some embodiments, the fusosome has (or is identified as having) a membrane potential of about −25 to −35, −27 to −32, −28 to −31, −29 to −30, or −29.6 millivolts, e.g., in an assay of Example 78. In some embodiments, the fusosome is capable of extravasation from blood vessels, e.g., at a rate at least 1%, 2%, 5%, 10%, 20%, 30%, 40%, 50%, 60%, 70%, 80%, or 90% the rate of extravasation of the source cell, e.g., using an assay of Example 44, e.g., wherein the source cell is a neutrophil, lymphocyte, B cell, macrophage, or NK cell. In some embodiments, the fusosome is capable of chemotaxis, e.g., of at least 1%, 2%, 3%, 4%, 5%, 10%, 20%, 30%, 40%, 50%, 60%, 70%, 80%, or 90% (e.g., up to 100%) compared to a reference cell, e.g., a macrophage, e.g., using an assay of Example 45. In some embodiments, the fusosome is capable of phagocytosis, e.g., at least 1%, 2%, 3%, 4%, 5%, 10%, 20%, 30%, 40%, 50%, 60%, 70%, 80%, or 90% (e.g., up to 100%) compared to a reference cell, e.g., a macrophage, e.g., using an assay of Example 47. In some embodiments, the fusosome is capable of crossing a cell membrane, e.g., an endothelial cell membrane or the blood brain barrier. In some embodiments, the fusosome is capable of secreting a protein, e.g., at a rate at least 1%, 2%, 3%, 4%, 5%, 10%, 20%, 30%, 40%, 50%, 60%, 70%, 80%, 90%, or 100% greater than a reference cell, e.g., a mouse embryonic fibroblast, e.g., using an assay of Example 48. In some embodiments, the fusosome is capable of secreting a protein, e.g., at a rate at least 1%, 2%, 3%, 4%, 5%, 10%, 20%, 30%, 40%, 50%, 60%, 70%, 80%, or 90% (e.g., up to 100%) compared to a reference cell, e.g., a mouse embryonic fibroblast, e.g., using an assay of Example 48.

In some embodiments, the fusosome is not capable of transcription or has transcriptional activity of less than 1%, 2.5% 5%, 10%, 20%, 30%, 40%, 50%, 60%, 70%, 80%, or 90% of that of the transcriptional activity of a reference cell, e.g., the source cell, e.g., using an assay of Example 24. In some embodiments, the fusosome is not capable of nuclear DNA replication or has nuclear DNA replication of less than 1%, 2.5% 5%, 10%, 20%, 30%, 40%, 50%, 60%, 70%, 80%, or 90% of the nuclear DNA replication of a reference cell, e.g., the source cell, e.g., using an assay of Example 25. In some embodiments, the fusosome lacks chromatin or has a chromatin content of less than 1%, 2.5% 5%, 10%, 20%, 30%, 40%, 50%, 60%, 70%, 80%, or 90% of the of the chromatin content of a reference cell, e.g., the source cell, e.g., using an assay of Example 32.

In some embodiments, a characteristic of a fusosome is described by comparison to a reference cell. In embodiments, the reference cell is the source cell. In embodiments, the reference cell is a HeLa, HEK293, HFF-1, MRC-5, WI-38, IMR 90, IMR 91, PER.C6, HT-1080, or BJ cell. In some embodiments, a characteristic of a population of fusosomes is described by comparison to a population of reference cells, e.g., a population of source cells, or a population of HeLa, HEK293, HFF-1, MRC-5, WI-38, IMR 90, IMR 91, PER.C6, HT-1080, or BJ cells.

In some embodiments, the fusosome meets a pharmaceutical or good manufacturing practices (GMP) standard. In some embodiments, the fusosome was made according to good manufacturing practices (GMP). In some embodiments, the fusosome has a pathogen level below a predetermined reference value, e.g., is substantially free of pathogens. In some embodiments, the fusosome has a contaminant level below a predetermined reference value, e.g., is substantially free of contaminants. In some embodiments, the fusosome has low immunogenicity, e.g., as described herein.

In some embodiments, immunogenicity of a fusosome composition is assayed by a serum inactivation assay (e.g., an assay that detects antibody-mediated neutralization or complement mediated degradation). In some embodiments, fusosomes are not inactivated by serum, or are inactivated at a level below a predetermined value. In some embodiments, serum of a fusosome-naïve subject (e.g., human or mouse) is contacted with a test fusosome composition. In some embodiments, the serum of a subject that has received one or more administrations of fusosomes, e.g., has received at least two administrations of fusosomes, is contacted with the test fusosome composition. In embodiments, serum-exposed fusosomes are then tested for ability to deliver a cargo to target cells. In some embodiments, the percent of cells that detectably comprise the cargo after treatment with serum-incubated fusosomes is at least 50%, 60%, 70%, 80%, 90%, or 95% the percent of cells that detectably comprise the cargo after treatment with positive control fusosomes not contacted with serum. In some embodiments, serum inactivation is measured using an assay of Example 99.

In some embodiments, immunogenicity of a fusosome composition is assayed by detecting complement activation in response to the fusosomes. In some embodiments, the fusosomes do not activate complement, or activate complement at a level below a predetermined value. In some embodiments, serum of a fusosome-naïve subject (e.g., human or mouse) is contacted with a test fusosome composition. In some embodiments, the serum of a subject that has received one or more administrations of fusosomes, e.g., has received at least two administrations of fusosomes, is contacted with the test fusosome composition. In embodiments, the composition comprising serum and fusosomes is then tested for an activated complement factor (e.g., C3a), e.g., by ELISA. In some embodiments, a fusosome comprising a modification described herein (e.g., elevated levels of a complement regulatory protein compared to a reference cell) undergoes reduced complement activation compared to an otherwise similar fusosome that lacks the modification, e.g., reduced by at least 5%, 10%, 20%, 30%, 40%, 50%, 60%, 70%, 80%, 90%, 95%, 98%, or 99%. In some embodiments, complement activation is measured using an assay of Example 100.

In some embodiments, a fusosome or population of fusosomes will not be substantially inactivated by serum. In some embodiments, a fusosome or population of fusosomes is resistant to serum inactivation, e.g., as quantified according to the method described in Example 99. In embodiments, the fusosome or population of fusosomes is not substantially inactivated by serum or is resistant to serum inactivation following multiple administrations of the fusosome or population of fusosomes to a subject, e.g., according to the methods described herein. In some embodiments, a fusosome is modified to have a reduced serum inactivation, e.g., compared to a corresponding unmodified fusosome, e.g., following multiple administrations of the modified fusosome, e.g., as quantified according to the method described in Example 99.

In some embodiments, a fusosome does not substantially induce complement activity, e.g., as measured according to the method described in Example 100. In some embodiments, a fusosome is modified to induce reduced complement activity compared to a corresponding unmodified fusosome. In embodiments, complement activity is measured by determining expression or activity of a complement protein (e.g., DAF, proteins that bind decay-accelerating factor (DAF, CD55), e.g., factor H (FH)-like protein-1 (FHL-1), C4b-binding protein (C4BP), complement receptor 1 (CD35), Membrane cofactor protein (MCP, CD46), PROFECTIN™ (CD59), proteins that inhibit the classical and alternative complement pathway CD/C5 convertase enzymes, or proteins that regulate MAC assembly) in a cell In some embodiments, the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial glial cell, a bone marrow stromal cell, a pancreatic progenitor cell, an endothelial progenitor cell, a blast cell), or an immortalized cell (e.g., HeLa, HEK293, HFF-1, MRC- 5, WI-38, IMR 90, IMR 91, PER.C6, HT-1080, or BJ cell). In some embodiments, the source cell is other than a 293 cell, HEK cell, human endothelial cell, or a human epithelial cell, monocyte, macrophage, dendritic cell, or stem cell.

In some embodiments, the source cell expresses (e.g., overexpresses) ARRDC1 or an active fragment or variant thereof. In some embodiments, the fusosome or fusosome composition has a ratio of fusogen to ARRDC1 of about 1-3, 1-10, 1-100, 3-10, 4-9, 5-8, 6-7, 15-100, 60-200, 80-180, 100-160, 120-140, 3-100, 4-100, 5-100, 6-100, 15-100, 80-100, 3-200, 4-200, 5-200, 6-200, 15-200, 80-200, 100-200, 120-200, 300-1000, 400-900, 500-800, 600-700, 640-690, 650-680, 660-670, 100-10,000, or about 664.9, e.g., by a mass spectrometry assay. In some embodiments, the level of ARRDC1 as a percentage of total protein content is at least about 0.01%, 0.02%, 0.03%, 0.04%, 0.05%; 0.1%, 0.15%, 0.2%, 0.25%; 0.5%, 1%, 2%, 3%, 4%, 5%; or the level of ARRDC1 as a percentage of total protein content is about 0.05-1.5%, 0.1%-0.3%, 0.05-0.2%, 0.1-0.2%, 0.25-7.5%, 0.5%-1.5%, 0.25-1%, 0.5-1%, 0.05-1.5%, 10%-30%, 5-20%, or 10-20%, e.g., by mass spectrometry, e.g., as measured according to the method described in Example 98. In some embodiments, the fusosome or fusosome composition has a ratio of fusogen to TSG101 of about 100-1,000, 100-400, 100-500, 200-400, 200-500, 200-1,000, 300-400, 1,000-10,000, 2,000-5,000, 3,000-4,000, 3,050-3,100, 3,060-3,070, or about 3,064, 10,000-100,000, 10,000-200,000, 10,000-500,000, 20,000-500,000, 30,000-400,000, e.g., using a mass spectrometry assay, e.g., an assay of Example 94. In some embodiments, the fusosome or fusosome composition has a ratio of cargo to tsg101 of about 1-3, 1-30, 1-20, 1-25, 1.5-30, 10-30, 15-25, 18-21, 19-20, 10-300, 10-200, 15-300, 15-200, 100-300, 100-200, 150-300, or about 19.5, e.g., using a mass spectrometry assay, e.g., an assay of Example 95. In some embodiments, the level of TSG101 as a percentage of total protein content is at least about 0.0001%, 0.0002%, 0.0003%, 0.0004%, 0.0005%, 0.0006%, 0.0007%, 0.001%, 0.002%, 0.003%, 0.004%, 0.005%, 0.006%, 0.007%; 0.01%, 0.02%, 0.03%, 0.04%, 0.05%, 0.06%, 0.07%; or the level of TSG101 as a percentage of total protein content is about 0.0001-0.001, 0.0001-0.002, 0.0001-0.01, 0.0001-0.1, 0.001-0.01, 0.002-0.006, 0.003-0.005, 0.001-0.1, 0.01-0.1, 0.02-0.06, 0.03-0.05, or 0.004, e.g., by mass spectrometry, e.g., as measured according to the method described in Example 98.

In some embodiments, the fusosome comprises a cargo, e.g., a therapeutic agent, e.g., an endogenous therapeutic agent or an exogenous therapeutic agent. In some embodiments, the therapeutic agent is chosen from one or more of a protein, e.g., an enzyme, a transmembrane protein, a receptor, an antibody; a nucleic acid, e.g., DNA, a chromosome (e.g. a human artificial chromosome), RNA, mRNA, siRNA, miRNA, or a small molecule. In some embodiments, the therapeutic agent is an organelle other than a mitochondrion, e.g., an organelle selected from: nucleus, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule. In some embodiments, the organelle is a mitochondrion.

In some embodiments, the fusosome enters the target cell by endocytosis, e.g., wherein the level of therapeutic agent delivered via an endocytic pathway is 0.01-0.6, 0.01-0.1, 0.1-0.3, or 0.3-0.6, or at least 1%, 2%, 3%, 4%, 5%, 10%, 20%, 30%, 40%, 50%, 60%, 70%, 80%, 90% or greater than a chloroquine treated reference cell contacted with similar fusosomes, e.g., using an assay of Example 62. In some embodiments, at least 1%, 2%, 3%, 4%, 5%, 10%, 20%, 30%, 40%, 50%, 60%, 70%, 80%, 90% of fusosomes in a fusosome composition that enter a target cell enter via a non-endocytic pathway, e.g., the fusosomes enter the target cell via fusion with the cell surface. In some embodiments, the level of a therapeutic agent delivered via a non-endocytic pathway for a given fusosome is 0.1-0.95, 0.1-0.2, 0.2-0.3, 0.3-0.4, 0.4-0.5, 0.5-0.6, 0.6-0.7, 0.7-0.8, 0.8-0.9, 0.9-0.95, or at least at least 1%, 2%, 3%, 4%, 5%, 10%, 20%, 30%, 40%, 50%, 60%, 70%, 80%, 90% or greater than a chloroquine treated reference cell, e.g., using an assay of Example 61. In some embodiments, at least 1%, 2%, 3%, 4%, 5%, 10%, 20%, 30%, 40%, 50%, 60%, 70%, 80%, 90% of fusosomes in a fusosome composition that enter a target cell enter the cytoplasm (e.g., do not enter an endosome or lysosome). In some embodiments, less than 90%, 80%, 70%, 60%, 50%, 40%, 30%, 20%, 10%, 5%, 4%, 3%, 2%, or 1% of fusosomes in a fusosome composition that enter a target cell enter an endosome or lysosome. In some embodiments, the fusosome enters the target cell by a non-endocytic pathway, e.g., wherein the level of therapeutic agent delivered is at least 90%, 95%, 98%, or 99% that of a chloroquine treated reference cell, e.g., using an assay of Example 62. In an embodiment, a fusosome delivers an agent to a target cell via a dynamin mediated pathway. In an embodiment, the level of agent delivered via a dynamin mediated pathway is in the range of 0.01-0.6, or at least 1%, 2%, 3%, 4%, 5%, 10%, 20%, 30%, 40%, 50%, 60%, 70%, 80%, 90% or greater than Dynasore treated target cells contacted with similar fusosomes, e.g., as measured in an assay of Example 63. In an embodiment, a fusosome delivers an agent to a target cell via macropinocytosis. In an embodiment, the level of agent delivered via macropinocytosis is in the range of 0.01-0.6, or at least 1%, 2%, 3%, 4%, 5%, 10%, 20%, 30%, 40%, 50%, 60%, 70%, 80%, 90% or greater than EIPA treated target cells contacted with similar fusosomes, e.g., as measured in an assay of Example 63. In an embodiment, a fusosome delivers an agent to a target cell via an actin-mediated pathway. In an embodiment, the level of agent delivered via an actin-mediated pathway will be in the range of 0.01-0.6, or at least 1%, 2%, 3%, 4%, 5%, 10%, 20%, 30%, 40%, 50%, 60%, 70%, 80%, 90% or greater than Latrunculin B treated target cells contacted with similar fusosomes, e.g., as measured in an assay of Example 63.

In some embodiments, the fusosome has a density of <1, 1-1.1, 1.05-1.15, 1.1-1.2, 1.15-1.25, 1.2-1.3, 1.25-1.35, or >1.35 g/ml, e.g., by an assay of Example 30.

In some embodiments, the fusosome composition comprises less than 0.01%, 0.05%, 0.1%, 0.5%, 1%, 1.5%, 2%, 2.5%, 3%, 4%, 5%, or 10% source cells by protein mass or less than 0.01%, 0.05%, 0.1%, 0.5%, 1%, 1.5%, 2%, 2.5%, 3%, 4%, 5%, or 10% of cells have a functional nucleus. In some embodiments, at least 10%, 20%, 30%, 40%, 50%, 60%, 70%, 80%, 90%, 95%, or 99% of fusosomes in the fusosome composition comprise an organelle, e.g., a mitochondrion.

In some embodiments, the fusosome further comprises an exogenous therapeutic agent. In some embodiments, the exogenous therapeutic agent is chosen from one or more of a protein, e.g., an enzyme, a transmembrane protein, a receptor, an antibody; a nucleic acid, e.g., DNA, a chromosome (e.g. a human artificial chromosome), RNA, mRNA, siRNA, miRNA, or a small molecule.

In embodiments, the fusosome enters the cell by endocytosis or a non-endocytic pathway.

In embodiments, the fusosome composition is stable at a temperature of less than 4 C for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years. In embodiments, the fusosome composition is stable at a temperature of less than-20 C for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years. In embodiments, the fusosome composition is stable at a temperature of less than-80 C for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years.

In embodiments, the fusosome has a size, or the population of fusosomes has an average size, within about 0.01%, 0.05%, 0.1%, 0.5%, 1%, 2%, 3%, 4%, 5%, 10%, 20%, 30%, 40%, 50%, 60%, 70%, 80%, 90%, of that of the source cell, e.g., as measured by an assay of Example 27. In embodiments, the fusosome has a size, or the population of fusosomes has an average size, that is less than about 0.01%, 0.05%, 0.1%, 0.5%, 1%, 2%, 3%, 4%, 5%, 10%, 20%, 30%, 40%, 50%, 60%, 70%, 80%, 90%, of that of the source cell, e.g., as measured by an assay of Example 27. In embodiments, the fusosomes have (or are identified as having) a size less than parental cells. In embodiments, the fusosomes have (or are identified as having) a size within about 50%, 60%, 65%, 70%, 71%, 72%, 73%, 74%, 75%, 80%, or 90% of parental cells. In embodiments, the fusosomes have (or are identified as having) less than about 70%, 60%, 50%, 40%, 30%, 20%, 10%, 5%, 1%, or less of the parental cell's variability in size distribution, e.g., within about 90% of the sample. In embodiments, the fusosomes have (or are identified as having) about 40%, 45%, 50%, 55%, 56%, 57%, 58%, 59%, 60%, 65%, or 70% less of the parental cell's variability in size distribution, e.g., within about 90% of the sample. In some embodiments, fusosomes have (or are identified as having) an average size of greater than 30, 35, 40, 45, 50, 55, 60, 65, or 70 nm in diameter. In embodiments, fusosomes have an average size of about 100, 110, 120, 125, 126, 127, 128, 129, 130, 131, 132, 133, 134, 135, 140, or 150 nm in diameter. In embodiments, the fusosome has a size, or the population of fusosomes has an average size, within about 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% the size of the source cell, e.g., as measured by an assay of Example 27. In embodiments, the fusosome has a size, or the population of fusosomes has an average size, that is less than about 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of the size of the source cell, e.g., as measured by an assay of Example 27. In embodiments, the fusosome has a diameter, or the population of fusosomes has an average diameter, of less than about 500 nm (e.g., less than about 10, 50, 100, 150, 200, 250, 300, 350, 400, or 450 nm), e.g., as measured by an assay of Example 69. In embodiments, the fusosome has a diameter, or the population of fusosomes has an average diameter, of about 80-180, 90-170, 100-160, 110-150, 120-140, or 130 nm, e.g., as measured by an assay of Example 69. In embodiments, the fusosome has a diameter, or the population of fusosomes has an average diameter, of between about 11,000 nm and 21,000 nm, e.g., as measured by an assay of Example 69. In embodiments, the fusosome has a diameter, or the population of fusosomes has an average diameter, between about 10-22,000, 12-20,000, 14-18,720 nm, 20-16,000 nm, e.g., as measured by an assay of Example 69. In embodiments, the fusosome has a volume, or the population of fusosomes has an average volume, of about 0.01-0.1 $\mu m^3$, 0.02-1 $\mu m^3$, 0.03-1 $\mu m^3$, 0.04-1 $\mu m^3$, 0.05-0.09 $\mu m^3$, 0.06-0.08 $\mu m^3$, 0.07 $\mu m^3$, e.g., as measured by an assay of Example 69. In embodiments, the fusosome has a diameter, or the population of fusosomes has an average diameter, of at least about 10 nm, 20 nm, 30 nm, 40 nm, 50 nm, 60 nm, 70 nm, 80 nm, 90 nm, 100 nm, 150 nm, 200 nm, or 250 nm e.g., as measured by an assay of Example 29. In embodiments, the fusosome has a diameter, or the population of fusosomes has an average diameter, of about 10 nm, 20 nm, 30 nm, 40 nm, 50 nm, 60 nm, 70 nm, 80 nm, 90 nm, 100 nm, 150 nm, 200 nm, or 250 nm (e.g., +20%) e.g., as measured by an assay of Example 29. In embodiments, the fusosome has a diameter, or the population of fusosomes has an average diameter, of at least about 500 nm, 750 nm, 1,000 nm, 1,500 nm, 2,000 nm, 2,500 nm, 3,000 nm, 5,000 nm, 10,000 nm, or 20,000 nm, e.g., as measured by an assay of Example 29. In embodiments, the fusosome has a diameter, or the population of fusosomes has an average diameter, of about 500 nm, 750 nm, 1,000 nm, 1,500 nm, 2,000 nm, 2,500 nm, 3,000 nm, 5,000 nm, 10,000 nm, or 20,000 nm (e.g., +20%), e.g., as measured by an assay of Example 29. In embodiments, the population of fusosomes has (or is identified as having) one or more of: a 10% quantile diameter of about 40-90 nm, 45-60 nm, 50-55 nm or 53 nm; a 25% quantile diameter of about 70-100 nm, 80-95 nm, 85-90 nm, or 88 nm; a 75% quantile diameter of about 200-250 nm, 210-240 nm, 220-230 nm, or 226 nm; or a 90% quantile of about 4000-5000 nm, 4300-4600 nm, 4400-4500 nm, 4450 nm, e.g., by an assay of Example 68.

In embodiments, the fusosome composition comprises (or is identified as comprising) a GAPDH concentration of about 35-40, 36-39, 37-38, or 37.2 ng/ml, e.g., in an assay of Example 82. In embodiments, the GAPDH concentration of the fusosome composition is (or is identified as being) within about 1%, 2%, 5%, 10%, or 20% of the GAPDH concentration of the source cells, e.g., in an assay of Example 82. In embodiments, the GAPDH concentration of the fusosome composition is (or is identified as being) at least 1%, 2%, 5%, 10%, or 20% lower than the the GAPDH concentration of the source cells, e.g., in an assay of Example 82. In embodiments, the the fusosome composition comprises (or is identified as comprising) less than about 30, 35, 40, 45, 46, 47, 48, 49, 50, 55, 60, 65, or 70 μg GAPDH per gram total protein. In embodiments, the fusosome composition comprises (or is identified as comprising) less than about 500, 250, 100, or 50 μg GAPDH per gram total protein. In embodiments, the parental cell comprises (or is identified as comprising) at least 1%, 2.5%, 5%, 10%, 15%, 20%, 30%, 30%, 50%, or more GAPDH per total protein than the fusosome composition.

In embodiments, the average fractional content of calnexin in the fusosome is (or is identified as being) less than about $1\times10^4$, $1.5\times10^{-4}$, $2\times10^4$, $2.1\times10^4$, $2.2\times10^4$, $2.3\times10^{-4}$, $2.4\times10^{-4}$, $2.43\times10^4$, $2.5\times10^4$, $2.6\times10^4$, $2.7\times10^4$, $2.8\times10^{-4}$, $2.9\times10^{-4}$, $3\times10^{-4}$, $3.5\times10^4$, or $4\times10^4$. In embodiments, the fusosome comprises an amount of calnexin per total protein that is lower than that of the parental cell by about 70%, 75%, 80%, 85%, 88%, 90%, 95%, 99%, or more.

In some embodiments, fusosomes comprise or are enriched for lipids that affect membrane curvature (see, e.g., Thiam et al., Nature Reviews Molecular Cell Biology, 14 (12): 775-785, 2013). Some lipids have a small hydrophilic head group and large hydrophobic tails, which facilitate the formation of a fusion pore by concentrating in a local region. In some embodiments, fusosomes comprise or are enriched for negative-curvature lipids, such as cholesterol, phosphatidylethanolamine (PE), diglyceride (DAG), phosphatidic acid (PA), fatty acid (FA). In some embodiments, fusosomes do not comprise, are depleted of, or have few positive-curvature lipids, such as lysophosphatidylcholine (LPC), phosphatidylinositol (Ptdlns), lysophosphatidic acid (LPA), lysophosphatidylethanolamine (LPE), monoacylglycerol (MAG).

In some embodiments, the lipids are added to a fusosome. In some embodiments, the lipids are added to source cells in culture which incorporate the lipids into their membranes prior to or during the formation of a fusosome. In some embodiments, the lipids are added to the cells or fusosomes in the form of a liposome. In some embodiments methyl-betacyclodextrane (mβ-CD) is used to enrich or deplete lipids (see, e.g., Kainu et al, Journal of Lipid Research, 51 (12): 3533-3541, 2010).

X. Pharmaceutical Compositions and Methods of Making them

The present disclosure also provides, in some aspects, a pharmaceutical composition comprising the fusosome composition described herein and pharmaceutically acceptable carrier. The pharmaceutical compositions can include any of the described fusosomes, e.g. retroviral vectors, or VLPs.

In some embodiments, one or more transducing units of retroviral vector are administered to the subject. In some embodiments, at least 1, 10, 100, 1000, $10^4$, $10^5$, $10^6$, $10^7$, $10^8$, $10^9$, $10^{10}$, $10^{11}$, $10^{12}$, $10^{13}$, or $10^{14}$, transducing units per kg are administered to the subject. In some embodiments at least 1, 10, 100, 1000, $10^4$, $10^5$, $10^6$, $10^7$, $10^8$, $10^9$, $10^{10}$, $10^{11}$, $10^{12}$, $10^{13}$, or $10^{14}$, transducing units per target cell per ml of blood are administered to the subject.

Concentration and Purification of Lentivirus

In some embodiments, a retroviral vector formulation described herein can be produced by a process comprising one or more of, e.g., all of, the following steps (i) to (vi), e.g., in chronological order:

(i) culturing cells that produce retroviral vector;
(ii) harvesting the retroviral vector containing supernatant;
(iii) optionally clarifying the supernatant;
(iv) purifying the retroviral vector to give a retroviral vector preparation;
(v) optionally filter-sterilization of the retroviral vector preparation; and
(vi) concentrating the retroviral vector preparation to produce the final bulk product.

In some embodiments the process does not comprise the clarifying step (iii). In other embodiments the process does include the clarifying step (iii). In some embodiments, step (vi) is performed using ultrafiltration, or tangential flow filtration, more preferably hollow fiber ultrafiltration. In some embodiments, the purification method in step (iv) is ion exchange chromatography, more preferably anion exchange chromatography. In some embodiments, the filter-sterilisation in step (v) is performed using a 0.22 μm or a 0.2 μm sterilising filter. In some embodiments, step (iii) is performed by filter clarification. In some embodiments, step (iv) is performed using a method or a combination of methods selected from chromatography, ultrafiltration/diafiltration, or centrifugation. In some embodiments, the chromatography method or a combination of methods is selected from ion exchange chromatography, hydrophobic interaction chromatography, size exclusion chromatography, affinity chromatography, reversed phase chromatography, and immobilized metal ion affinity chromatography. In some embodiments, the centrifugation method is selected from zonal centrifugation, isopycnic centrifugation and pelleting centrifugation. In some embodiments, the ultrafiltration/diafiltration method is selected from tangential flow diafiltration, stirred cell diafiltration and dialysis. In some embodiments, at least one step is included into the process to degrade nucleic acid to improve purification. In some embodiments, said step is nuclease treatment.

In some embodiments, concentration of the vectors is done before filtration. In some embodiments, concentration of the vectors is done after filtration. In some embodiments, concentration and filtrations steps are repeated.

In some embodiments, the final concentration step is performed after the filter-sterilisation step. In some embodiments, the process is a large scale-process for producing clinical grade formulations that are suitable for administration to humans as therapeutics. In some embodiments, the filter-sterilisation step occurs prior to a concentration step. In some embodiments, the concentration step is the final step in the process and the filter-sterilisation step is the penultimate step in the process. In some embodiments, the concentration step is performed using ultrafiltration, preferably tangential flow filtration, more preferably hollow fiber ultrafiltration. In some embodiments, the filter-sterilisation step is performed using a sterilising filter with a maximum pore size of about 0.22 μm. In another preferred embodiment the maximum pore size is 0.2 μm In some embodiments, the vector concentration is less than or equal to about $4.6 \times 10^{11}$ RNA genome copies per ml of preparation prior to filter-sterilisation. The appropriate concentration level can be achieved through controlling the vector concentration using, e.g. a dilution step, if appropriate. Thus, in some embodiments, a retroviral vector preparation is diluted prior to filter sterilisation.

Clarification may be done by a filtration step, removing cell debris and other impurities. Suitable filters may utilize cellulose filters, regenerated cellulose fibers, cellulose fibers combined with inorganic filter aids (e.g. diatomaceous earth, perlite, fumed silica), cellulose filters combined with inorganic filter aids and organic resins, or any combination thereof, and polymeric filters (examples include but are not limited to nylon, polypropylene, polyethersulfone) to achieve effective removal and acceptable recoveries. A multiple stage process may be used. An exemplary two or three-stage process would consist of a coarse filter(s) to remove large precipitate and cell debris followed by polishing second stage filter(s) with nominal pore sizes greater than 0.2 micron but less than 1 micron. The optimal combination may be a function of the precipitate size distribution as well as other variables. In addition, single stage operations employing a relatively small pore size filter or centrifugation may also be used for clarification. More generally, any clarification approach including but not limited to dead-end filtration, microfiltration, centrifugation, or body feed of filter aids (e.g. diatomaceous earth) in combination with dead-end or depth filtration, which provides a filtrate of suitable clarity to not foul the membrane and/or resins in the subsequent steps, will be acceptable to use in the clarification step of the present invention.

In some embodiments, depth filtration and membrane filtration is used. Commercially available products useful in this regard are for instance mentioned in WO 03/097797, p. 20-21. Membranes that can be used may be composed of different materials, may differ in pore size, and may be used in combinations. They can be commercially obtained from several vendors. In some embodiments, the filter used for clarification is in the range of 1.2 to 0.22 μm. In some embodiments, the filter used for clarification is either a 1.2/0.45 μm filter or an asymmetric filter with a minimum nominal pore size of 0.22 μm In some embodiments, the method employs nuclease to degrade contaminating DNA/RNA, i.e. mostly host cell nucleic acids. Exemplary nucleases suitable for use in the present invention include Benzonase® Nuclease (EP 0229866) which attacks and degrades all forms of DNA and RNA (single stranded, double stranded linear or circular) or any other DNase and/or RNase commonly used within the art for the purpose of eliminating unwanted or contaminating DNA and/or RNA from a preparation. In preferred embodiments, the nuclease is Benzonase® Nuclease, which rapidly hydrolyzes nucleic acids by hydrolyzing internal phosphodiester bonds between specific nucleotides, thereby reducing the size of the polynucleotides in the vector containing supernatant. Benzonase® Nuclease can be commercially obtained from Merck KGaA (code W214950). The concentration in which the nuclease is employed is preferably within the range of 1-100 units/ml.

In some embodiments, the vector suspension is subjected to ultrafiltration (sometimes referred to as diafiltration when used for buffer exchange) at least once during the process, e.g. for concentrating the vector and/or buffer exchange. The process used to concentrate the vector can include any filtration process (e.g., ultrafiltration (UF)) where the concentration of vector is increased by forcing diluent to be passed through a filter in such a manner that the diluent is removed from the vector preparation whereas the vector is unable to pass through the filter and thereby remains, in concentrated form, in the vector preparation. UF is described in detail in, e.g., Microfiltration and Ultrafiltration: Principles and Applications, L. Zeman and A. Zydney (Marcel Dekker, Inc., New York, N.Y., 1996); and in: Ultrafiltration Handbook, Munir Cheryan (Technomic Publishing, 1986; ISBN No. 87762-456-9). A suitable filtration process is Tangential Flow Filtration ("TFF") as described in, e.g., MILLIPORE catalogue entitled "Pharmaceutical Process Filtration Catalogue" pp. 177-202 (Bedford, Mass., 1995/96). TFF is widely used in the bioprocessing industry for cell harvesting, clarification, purification and concentration of products including viruses. The system is composed of three distinct process streams: the feed solution, the permeate and the retentate. Depending on application, filters with different pore sizes may be used. In some embodiments, the retentate contains the product (lentiviral vector). The particular ultrafiltration membrane selected may have a pore size sufficiently small to retain vector but large enough to effectively clear impurities. Depending on the manufacturer and membrane type, for retroviral vectors nominal molecular weight cutoffs (NMWC) between 100 and 1000 kDa may be appropriate, for instance membranes with 300 kDa or 500 kDa NMWC. The membrane composition may be, but is not limited to, regenerated cellulose, polyethersulfone, polysulfone, or derivatives thereof. The membranes can be flat sheets (also called flat screens) or hollow fibers. A suitable UF is hollow fibre UF, e.g., filtration using filters with a pore size of smaller than 0.1 μm. Products are generally retained, while volume can be reduced through permeation (or be kept constant during diafiltration by adding buffer with the same speed as the speed with which the permeate, containing buffer and impurities, is removed at the permeate side).

The two most widely used geometries for TFF in the biopharmaceutical industry are plate & frame (flat screens) and hollow fiber modules. Hollow fiber units for ultrafiltration and microfiltration were developed by Amicon and Ramicon in the early 1970s (Cheryan, M. Ultrafiltration Handbook), even though now there are multiple vendors including Spectrum and GE Healthcare. The hollow fiber modules consist of an array of self-supporting fibers with a dense skin layer. Fiber diameters range from 0.5 mm-3 mm. In certain embodiments, hollow fibers are used for TFF. In certain embodiments, hollow fibers of 500 kDa (0.05 μm) pore size are used. Ultrafiltration may comprise diafiltration (DF). Microsolutes can be removed by adding solvent to the solution being ultrafiltered at a rate equal to the UF rate. This washes microspecies from the solution at a constant volume, purifying the retained vector.

UF/DF can be used to concentrate and/or buffer exchange the vector suspensions in different stages of the purification process. The method can utilize a DF step to exchange the buffer of the supernatant after chromatography or other purification steps, but may also be used prior to chromatography.

In some embodiments, the eluate from the chromatography step is concentrated and further purified by ultrafiltration-diafiltration. During this process the vector is exchanged into formulation buffer. Concentration to the final desired concentration can take place after the filter-sterilisation step. After said sterile filtration, the filter sterilised substance is concentrated by aseptic UF to produce the bulk vector product.

In embodiments, the ultrafiltration/diafiltration may be tangential flow diafiltration, stirred cell diafiltration and dialysis.

Purification techniques tend to involve the separation of the vector particles from the cellular milieu and, if necessary, the further purification of the vector particles. One or more of a variety of chromatographic methods may be used for this purification. Ion exchange, and more particularly anion exchange, chromatography is a suitable method, and other methods could be used. A description of some chromatographic techniques is given below.

Ion-exchange chromatography utilises the fact that charged species, such as biomolecules and viral vectors, can bind reversibly to a stationary phase (such as a membrane, or else the packing in a column) that has, fixed on its surface, groups that have an opposite charge. There are two types of ion exchangers. Anion exchangers are stationary phases that bear groups having a positive charge and hence can bind species with a negative charge. Cation exchangers bear groups with a negative charge and hence can bind species with positive charge. The pH of the medium has an influence on this, as it can alter the charge on a species. Thus, for a species such as a protein, if the pH is above the pI, the net charge will be negative, whereas below the pI, the net charge will be positive.

Displacement (elution) of the bound species can be effected by the use of suitable buffers. Thus commonly the ionic concentration of the buffer is increased until the species is displaced through competition of buffer ions for the ionic sites on the stationary phase. An alternative method of elution entails changing the pH of the buffer until the net charge of the species no longer favours biding to the stationary phase. An example would be reducing the pH until the species assumes a net positive charge and will no longer bind to an anion exchanger.

Some purification can be achieved if impurities are uncharged, or else if they bear a charge of opposite sign to that of the desired species, but the same sign to that on the ion exchanger. This is because uncharged species and those having a charge of the same sign to that an ion exchanger, will not normally bind. For different bound species, the strength of the binding varies with factors such as the charge density and the distribution of charges on the various species. Thus by applying an ionic or pH gradient (as a continuous gradient, or as a series of steps), the desired species might be eluted separately from impurities.

Size exclusion chromatography is a technique that separates species according to their size. Typically it is performed by the use of a column packed with particles having pores of a well-defined size. For the chromatographic separation, particles are chosen that have pore sizes that are appropriate with regard to the sizes of the species in the mixture to be separated. When the mixture is applied, as a solution (or suspension, in the case of a virus), to the column and then eluted with buffer, the largest particles will elute first as they have limited (or no) access to the pores. Smaller particles will elute later as they can enter the pores and hence take a longer path through the column. Thus in considering the use of size exclusion chromatography for the purification of viral vectors, it would be expected that the vector would be eluted before smaller impurities such as proteins.

Species, such as proteins, have on their surfaces, hydrophobic regions that can bind reversibly to weakly hydrophobic sites on a stationary phase. In media having a relatively high salt concentration, this binding is promoted. Typically in HIC the sample to be purified is bound to the stationary phase in a high salt environment. Elution is then achieved by the application of a gradient (continuous, or as a series of steps) of decreasing salt concentration. A salt that is commonly used is ammonium sulphate. Species having differing levels of hydrophobicity will tend to be eluted at different salt concentrations and so the target species can be purified from impurities. Other factors, such as pH, temperature and additives to the elution medium such as detergents, chaotropic salts and organics can also influence the strength of binding of species to HIC stationary phases. One, or more, of these factors can be adjusted or utilised to optimise the elution and purification of product.

Viral vectors have on their surface, hydrophobic moieties such as proteins, and thus HIC could potentially be employed as a means of purification.

Like HIC, RPC separates species according to differences in their hydrophobicities. A stationary phase of higher hydrophobicity than that employed in HIC is used. The stationary phase often consists of a material, typically silica, to which are bound hydrophobic moieties such as alkyl groups or phenyl groups. Alternatively the stationary phase might be an organic polymer, with no attached groups. The sample-containing the mixture of species to be resolved is applied to the stationary phase in an aqueous medium of relatively high polarity which promotes binding. Elution is then achieved by reducing the polarity of the aqueous medium by the addition of an organic solvent such as isopropanol or acetonitrile. Commonly a gradient (continuous, or as a series of steps) of increasing organic solvent concentration is used and the species are eluted in order of their respective hydrophobicities.

Other factors, such as the pH of the elution medium, and the use of additives, can also influence the strength of binding of species to RPC stationary phases. One, or more, of these factors can be adjusted or utilised to optimise the elution and purification of product. A common additive is trifluororacetic acid (TFA). This suppresses the ionisation of acidic groups such as carboxyl moieties in the sample. It also reduces the pH in the eluting medium and this suppresses the ionisation of free silanol groups that may be present on the surface of stationary phases having a silica matrix. TFA is one of a class of additives known as ion pairing agents. These interact with ionic groups, present on species in the sample, that bear an opposite charge. The interaction tends to mask the charge, increasing the hydrophobicity of the species. Anionic ion pairing agents, such as TFA and pentafluoropropionic acid interact with positively charged groups on a species. Cationic ion pairing agents such, as triethylamine, interact with negatively charged groups.

Viral vectors have on their surface, hydrophobic moieties such as proteins, and thus RPC, potentially, could be employed as a means of purification.

Affinity chromatography utilises the fact that certain ligands that bind specifically with biomolecules such as proteins or nucleotides, can be immobilised on a stationary phase. The modified stationary phase can then be used to separate the relevant biomolecule from a mixture. Examples of highly specific ligands are antibodies, for the purification of target antigens and enzyme inhibitors for the purification of enzymes. More general interactions can also be utilised such as the use of the protein A ligand for the isolation of a wide range of antibodies.

Typically, affinity chromatography is performed by application of a mixture, containing the species of interest, to the stationary phase that has the relevant ligand attached. Under appropriate conditions this will lead to the binding of the species to the stationary phase. Unbound components are then washed away before an eluting medium is applied. The eluting medium is chosen to disrupt the binding of the ligand to the target species. This is commonly achieved by choice of an appropriate ionic strength, pH or by the use of substances that will compete with the target species for ligand sites. For some bound species, a chaotropic agent such as urea is used to effect displacement from the ligand. This, however, can result in irreversible denaturation of the species.

Viral vectors have on their surface, moieties such as proteins, that might be capable of binding specifically to appropriate ligands. This means that, potentially, affinity chromatography could be used in their isolation.

Biomolecules, such as proteins, can have on their surface, electron donating moieties that can form coordinate bonds with metal ions. This can facilitate their binding to stationary phases carrying immobilised metal ions such as $Ni^{2+}$, $Cu^{2+}$, $Zn^{2+}$ or $Fe^{3+}$. The stationary phases used in IMAC have chelating agents, typically nitriloacetic acid or iminodiacetic acid covalently attached to their surface and it is the chelating agent that holds the metal ion. It is necessary for the chelated metal ion to have at least one coordination site left available to form a coordinate bond to a biomolecule. Potentially there are several moieties on the surface of biomolecules that might be capable of bonding to the immobilised metal ion. These include histidine, tryptophan and cysteine residues as well as phosphate groups. For proteins, however, the predominant donor appears to be the imidazole group of the histidine residue. Native proteins can be separated using IMAC if they exhibit suitable donor moieties on their surface. Otherwise IMAC can be used for the separation of recombinant proteins bearing a chain of several linked histidine residues.

Typically, IMAC is performed by application of a mixture, containing the species of interest, to the stationary phase. Under appropriate conditions this will lead to the coordinate bonding of the species to the stationary phase. Unbound components are then washed away before an eluting medium is applied. For elution, gradients (continuous, or as a series of steps) of increasing salt concentration or decreasing pH may be used. Also a commonly used procedure is the application of a gradient of increasing imidazole concentration. Biomolecules having different donor properties, for example having histidine residues in differing environments, can be separated by the use of gradient elution.

Viral vectors have on their surface, moieties such as proteins, that might be capable of binding to IMAC stationary phases. This means that, potentially, IMAC could be used in their isolation.

Suitable centrifugation techniques include zonal centrifugation, isopycnic ultra and pelleting centrifugation.

Filter-sterilisation is suitable for processes for pharmaceutical grade materials. Filter-sterilisation renders the resulting formulation substantially free of contaminants. The level of contaminants following filter-sterilisation is such that the formulation is suitable for clinical use. Further concentration (e.g. by ultrafiltration) following the filter-sterilisation step may be performed in aseptic conditions. In some embodiments, the sterilising filter has a maximum pore size of 0.22 μm.

The retroviral vectors herein can also be subjected to methods to concentrate and purify a lentiviral vector using flow-through ultracentrifugation and high-speed centrifugation, and tangential flow filtration. Flow through ultracentrifugation can be used for the purification of RNA tumor viruses (Toplin et al, Applied Microbiology 15:582-589, 1967; Burger et al., Journal of the National Cancer Institute 45:499-503, 1970). Flow-through ultracentrifugation can be used for the purification of Lentiviral vectors. This method can comprise one or more of the following steps. For example, a lentiviral vector can be produced from cells using a cell factory or bioreactor system. A transient transfection system can be used or packaging or producer cell lines can also similarly be used. A pre-clarification step prior to loading the material into the ultracentrifuge could be used if desired. Flow-through ultracentrifugation can be performed using continuous flow or batch sedimentation. The materials used for sedimentation are, e.g.: Cesium chloride, potassium tartrate and potassium bromide, which create high densities with low viscosity although they are all corrosive. CsCl is frequently used for process development as a high degree of purity can be achieved due to the wide density gradient that can be created (1.0 to 1.9 g/cm$^3$). Potassium bromide can be used at high densities, e.g., at elevated temperatures, such as 25° C., which may be incompatible with stability of some proteins. Sucrose is widely used due to being inexpensive, non-toxic and can form a gradient suitable for separation of most proteins, sub-cellular fractions and whole cells. Typically the maximum density is about 1.3 g/cm$^3$. The osmotic potential of sucrose can be toxic to cells in which case a complex gradient material can be used, e.g. Nycodenz. A gradient can be used with 1 or more steps in the gradient. An embodiment is to use a step sucrose gradient. The volume of material can be from 0.5 liters to over 200 liters per run. The flow rate speed can be from 5 to over 25 liters per hour. A suitable operating speed is between 25,000 and 40,500 rpm producing a force of up to 122,000×g. The rotor can be unloaded statically in desired volume fractions. An embodiment is to unload the centrifuged material in 100 ml fractions. The isolated fraction containing the purified and concentrated Lentiviral vector can then be exchanged in a desired buffer using gel filtration or size exclusion chromatography. Anionic or cationic exchange chromatography could also be used as an alternate or additional method for buffer exchange or further purification. In addition, Tangential Flow Filtration can also be used for buffer exchange and final formulation if required. Tangential Flow Filtration (TFF) can also be used as an alternative step to ultra or high speed centrifugation, where a two step TFF procedure would be implemented. The first step would reduce the volume of the vector supernatant, while the second step would be used for buffer exchange, final formulation and some further concentration of the material. The TFF membrane can have a membrane size of between 100 and 500 kilodaltons, where the first TFF step can have a membrane size of 500 kilodaltons, while the second TFF can have a membrane size of between 300 to 500 kilodaltons. The final buffer should contain materials that allow the vector to be stored for long term storage.

In embodiments, the method uses either cell factories that contains adherent cells, or a bioreactor that contains suspension cells that are either transfected or transduced with the vector and helper constructs to produce lentiviral vector. Non limiting examples or bioreactors, include the Wave bioreactor system and the Xcellerex bioreactors. Both are disposable systems. However non-disposable systems can also be used. The constructs can be those described herein, as well as other lentiviral transduction vectors. Alternatively the cell line can be engineered to produce Lentiviral vector without the need for transduction or transfection. After transfection, the lentiviral vector can be harvested and filtered to remove particulates and then is centrifuged using continuous flow high speed or ultra centrifugation. A preferred embodiment is to use a high speed continuous flow device like the JCF-A zonal and continuous flow rotor with a high speed centrifuge. Also preferably is the use of Contifuge Stratus centrifuge for medium scale Lentiviral vector production. Also suitable is any continuous flow centrifuge where the speed of centrifugation is greater than 5,000×g RCF and less than 26,000×g RCF. Preferably, the continuous flow centrifugal force is about 10,500×g to 23,500×g RCF with a spin time of between 20 hours and 4 hours, with longer centrifugal times being used with slower centrifugal force. The lentiviral vector can be centrifuged on a cushion of more dense material (a non limiting example is sucrose but other reagents can be used to form the cushion and these are well known in the art) so that the Lentiviral vector does not form aggregates that are not filterable, as sometimes occurs with straight centrifugation of the vector that results in a viral vector pellet. Continuous flow centrifugation onto a cushion allows the vector to avoid large aggregate formation, yet allows the vector to be concentrated to high levels from large volumes of transfected material that produces the Lentiviral vector. In addition, a second less-dense layer of sucrose can be used to band the Lentiviral vector preparation. The flow rate for the continuous flow centrifuge can be between 1 and 100 ml per minute, but higher and lower flow rates can also be used. The flow rate is adjusted to provide ample time for the vector to enter the core of the centrifuge without significant amounts of vector being lost due to the high flow rate. If a higher flow rate is desired, then the material flowing out of the continuous flow centrifuge can be re-circulated and passed through the centrifuge a second time. After the virus is concentrated using continuous flow centrifugation, the vector can be further concentrated using Tangential Flow Filtration (TFF), or the TFF system can be simply used for buffer exchange. A non-limiting example of a TFF system is the Xampler cartridge system that is produced by GB-Healthcare. Preferred cartridges are those with a MW cut-off of 500,000 MW or less. Preferably a cartridge is used with a MW cut-off of 300,000 MW. A cartridge of 100,000 MW cut-off can also be used. For larger volumes, larger cartridges can be used and it will be easy for those in the art to find the right TFF system for this final buffer exchange and/or concentration step prior to final fill of the vector preparation. The final fill preparation may contain factors that stabilize the vector-sugars are generally used and are known in the art.

Protein Content

In some embodiments the retroviral particle includes various source cell genome-derived proteins, exogenous proteins, and viral-genome derived proteins. In some embodiments the retroviral particle contains various ratios of source cell genome-derived proteins to viral-genome-derived proteins, source cell genome-derived proteins to exogenous proteins, and exogenous proteins to viral-genome derived proteins.

In some embodiments, the viral-genome derived proteins are GAG polyprotein precursor, HIV-1 Integrase, POL polyprotein precursor, Capsid, Nucleocapsid, p17 matrix, p6, p2, VPR, Vif.

In some embodiments, the source cell-derived proteins are Cyclophilin A, Heat Shock 70 kD, Human Elongation Factor −1 Alpha (EF-1R), Histones H1, H2A, H3, H4, beta-globin, Trypsin Precursor, Parvulin, Glyceraldehyde-3-phosphate dehydrogenase, Lck, Ubiquitin, SUMO-1, CD48, Syntenin-1, Nucleophosmin, Heterogeneous nuclear ribonucleoproteins C1/C2, Nucleolin, Probable ATP-dependent helicase DDX48, Matrin-3, Transitional ER ATPase, GTP-binding nuclear protein Ran, Heterogeneous nuclear ribonucleoprotein U, Interleukin enhancer binding factor 2, Non-POU domain containing octamer binding protein, RuvB like 2, HSP 90-b, HSP 90-a, Elongation factor 2, D-3-phosphoglycerate dehydrogenase, a-enolase, C-1-tetrahydrofolate synthase, cytoplasmic, Pyruvate kinase, isozymes M1/M2, Ubiquitin activating enzyme E1, 26S protease regulatory subunit S10B, 60S acidic ribosomal protein P2, 60S acidic ribosomal protein P0, 40S ribosomal protein SA, 40S ribosomal protein S2, 40S ribosomal protein S3, 60S ribosomal protein L4, 60S ribosomal protein L3, 40S ribosomal protein S3a, 40S ribosomal protein S7, 60S ribosomal protein L7a, 60S acidic ribosomal protein L31, 60S ribosomal protein L10a, 60S ribosomal protein L6, 26S proteasome non-ATPase regulatory subunit 1, Tubulin b-2 chain, Actin, cytoplasmic 1, Actin, aortic smooth muscle, Tubulin a-ubiquitous chain, Clathrin heavy chain 1, Histone H2B.b, Histone H4, Histone H3.1, Histone H3.3, Histone H2A type 8, 26S protease regulatory subunit 6A, Ubiquitin-4, RuvB like 1, 26S protease regulatory subunit 7, Leucyl-tRNA synthetase, cytoplasmic, 60S ribosomal protein L19, 26S proteasome non-ATPase regulatory subunit 13, Histone H2B.F, U5 small nuclear ribonucleoprotein 200 kDa helicase, Poly [ADP-ribose] polymerase-1, ATP-dependent DNA helicase II, DNA replication licensing factor MCM5, Nuclease sensitive element binding protein 1, ATP-dependent RNA helicase A, Interleukin enhancer binding factor 3, Transcription elongation factor B polypeptide 1, Pre-mRNA processing splicing factor 8, Staphylococcal nuclease domain containing protein 1, Programmed cell death 6-interacting protein, Mediator of RNA polymerase II transcription subunit 8 homolog, Nucleolar RNA helicase II, Endoplasmin, DnaJ homolog subfamily A member 1, Heat shock 70 kDa protein 1L, T-complex protein 1 e subunit, GCN1-like protein 1, Serotransferrin, Fructose bisphosphate aldolase A, Inosine-5'monophosphate dehydrogenase 2, 26S protease regulatory subunit 6B, Fatty acid synthase, DNA-dependent protein kinase catalytic subunit, 40S ribosomal protein S17, 60S ribosomal protein L7, 60S ribosomal protein L12, 60S ribosomal protein L9, 40S ribosomal protein S8, 40S ribosomal protein S4 X isoform, 60S ribosomal protein L11, 26S proteasome non-ATPase regulatory subunit 2, Coatomer a subunit, Histone H2A.z, Histone H1.2, Dynein heavy chain cytosolic. See: Saphire et al., *Journal of Proteome Research,* 2005, and Wheeler et al., *Proteomics Clinical Applications,* 2007.

In some embodiments the retroviral vector is pegylated.

Particle Size

In some embodiments the median retroviral vector diameter is between 10 and 1000 nM, 25 and 500 nm 40 and 300 nm, 50 and 250 nm, 60 and 225 nm, 70 and 200 nm, 80 and 175 nm, or 90 and 150 nm.

In some embodiments, 90% of the retroviral vectors fall within 50% of the median diameter of the retrovirus. In some embodiments, 90% of the retroviral vectors fall within 25% of the median diameter of the retrovirus. In some embodiments, 90% of the retroviral vectors fall within 20% of the median diameter of the retrovirus. In some embodiments, 90% of the retroviral vectors fall within 15% of the median diameter of the retrovirus. In some embodiments, 90% of the retroviral vectors fall within 10% of the median diameter of the retrovirus.

XI. Indications and Uses

The fusosomes, retroviral vectors, VLPs, or pharmaceutical compositions described herein can be administered to a subject, e.g., a mammal, e.g., a human. In such embodiments, the subject may be at risk of, may have a symptom of, or may be diagnosed with or identified as having, a particular disease or condition (e.g., a disease or condition described herein). In some embodiments, the disease is a disease or disorder, e.g., a disease or disorder listed in Table 5.

This disclosure also provides, in certain aspects, a method of administering a fusosome composition to a subject (e.g., a human subject), a target tissue, or a cell, comprising administering to the subject, or contacting the target tissue or the cell with a fusosome composition comprising a plurality of fusosomes described herein, a fusosome composition described herein, or a pharmaceutical composition described herein, thereby administering the fusosome composition to the subject.

This disclosure also provides, in certain aspects, a method of delivering a therapeutic agent (e.g., a polypeptide, a nucleic acid, a metabolite, an organelle, or a subcellular structure) to a subject, a target tissue, or a cell, comprising administering to the subject, or contacting the target tissue or the cell with, a plurality of fusosomes described herein, a fusosome composition comprising a plurality of fusosomes described herein, a fusosome composition described herein, or a pharmaceutical composition described herein, wherein the fusosome composition is administered in an amount and/or time such that the therapeutic agent is delivered.

This disclosure also provides, in certain aspects, a method of delivering a function to a subject, a target tissue, or a cell, comprising administering to the subject, or contacting the target tissue or the cell with, a plurality of fusosomes described herein, a fusosome composition comprising a plurality of fusosomes described herein, a fusosome composition described herein, or a pharmaceutical composition described herein, wherein the fusosome composition is administered in an amount and/or time such that the function is delivered.

Target cells from mammalian (e.g., human) tissue include cells from epithelial, connective, muscular, or nervous tissue or cells, and combinations thereof. Target mammalian (e.g., human) cells and organ systems include the cardiovascular system (heart, vasculature); digestive system (esophagus, stomach, liver, gallbladder, pancreas, intestines, colon, rectum and anus); endocrine system (hypothalamus, pituitary gland, pineal body or pineal gland, thyroid, parathyroids, adrenal glands); excretory system (kidneys, ureters, bladder); lymphatic system (lymph, lymph nodes, lymph vessels, tonsils, adenoids, thymus, spleen); integumentary system (skin, hair, nails); muscular system (e.g., skeletal muscle); nervous system (brain, spinal cord, nerves)'; reproductive system (ovaries, uterus, mammary glands, testes, vas deferens, seminal vesicles, prostate); respiratory system (pharynx, larynx, trachea, bronchi, lungs, diaphragm); skeletal system (bone, cartilage), and combinations thereof. In some embodiments, a non-target cells or organ system is chosen from the cardiovascular system (heart, vasculature); digestive system (esophagus, stomach, liver, gallbladder, pancreas, intestines, colon, rectum and anus); endocrine system (hypothalamus, pituitary gland, pineal body or pineal gland, thyroid, parathyroids, adrenal glands); excretory system (kidneys, ureters, bladder); lymphatic system (lymph, lymph nodes, lymph vessels, tonsils, adenoids, thymus, spleen); integumentary system (skin, hair, nails); muscular system (e.g., skeletal muscle); nervous system (brain, spinal cord, nerves)'; reproductive system (ovaries, uterus, mammary glands, testes, vas deferens, seminal vesicles, prostate); respiratory system (pharynx, larynx, trachea, bronchi, lungs, diaphragm); skeletal system (bone, cartilage), and combinations thereof.

The administration of a pharmaceutical composition described herein may be by way of oral, inhaled, transdermal or parenteral (including intravenous, intratumoral, intraperitoneal, intramuscular, intracavity, and subcutaneous) administration. The fusosomes may be administered alone or formulated as a pharmaceutical composition.

In embodiments, the fusosome composition mediates an effect on a target cell, and the effect lasts for at least 1, 2, 3, 4, 5, 6, or 7 days, 2, 3, or 4 weeks, or 1, 2, 3, 6, or 12 months. In some embodiments (e.g., wherein the fusosome composition comprises an exogenous protein), the effect lasts for less than 1, 2, 3, 4, 5, 6, or 7 days, 2, 3, or 4 weeks, or 1, 2, 3, 6, or 12 months.

In embodiments, the fusosome composition described herein is delivered ex-vivo to a cell or tissue, e.g., a human cell or tissue.

The fusosome compositions described herein can be administered to a subject, e.g., a mammal, e.g., a human. In such embodiments, the subject may be at risk of, may have a symptom of, or may be diagnosed with or identified as having, a particular disease or condition (e.g., a disease or condition described herein).

In some embodiments, the source of fusosomes are from the same subject that is administered a fusosome composition. In other embodiments, they are different. For example, the source of fusosomes and recipient tissue may be autologous (from the same subject) or heterologous (from different subjects). In either case, the donor tissue for fusosome compositions described herein may be a different tissue type than the recipient tissue. For example, the donor tissue may be muscular tissue and the recipient tissue may be connective tissue (e.g., adipose tissue). In other embodiments, the donor tissue and recipient tissue may be of the same or different type, but from different organ systems.

In some embodiments, the fusosome is co-administered with an inhibitor of a protein that inhibits membrane fusion. For example, Suppressyn is a human protein that inhibits cell-cell fusion (Sugimoto et al., "A novel human endogenous retroviral protein inhibits cell-cell fusion" Scientific Reports 3:1462 DOI: 10.1038/srep01462). Thus, in some embodiments, the fusosome is co-administered with an inhibitor of sypressyn, e.g., a siRNA or inhibitory antibody.

Compositions described herein may also be used to similarly modulate the cell or tissue function or physiology of a variety of other organisms including but not limited to: farm or working animals (horses, cows, pigs, chickens etc.), pet or zoo animals (cats, dogs, lizards, birds, lions, tigers and bears etc.), aquaculture animals (fish, crabs, shrimp, oysters etc.), plants species (trees, crops, ornamentals flowers etc), fermentation species (saccharomyces etc.). Fusosome compositions described herein can be made from such non-human sources and administered to a non-human target cell or tissue or subject.

Fusosome compositions can be autologous, allogeneic or xenogeneic to the target.

XII. Additional Therapeutic Agents

In some embodiments, the fusosome composition is co-administered with an additional agent, e.g., a therapeutic agent, to a subject, e.g., a recipient, e.g., a recipient described herein. In some embodiments, the co-administered therapeutic agent is an immunosuppressive agent, e.g., a glucocorticoid (e.g., dexamethasone), cytostatic (e.g., methotrexate), antibody (e.g., Muromonab-CD3), or immunophilin modulator (e.g., Ciclosporin or rapamycin). In embodiments, the immunosuppressive agent decreases immune mediated clearance of fusosomes. In some embodiments the fusosome composition is co-administered with an immunostimulatory agent, e.g., an adjuvant, an interleukin, a cytokine, or a chemokine.

In some embodiments, the fusosome composition and the immunosuppressive agent are administered at the same time, e.g., contemporaneously administered. In some embodiments, the fusosome composition is administered before administration of the immunosuppressive agent. In some embodiments, the fusosome composition is administered after administration of the immunosuppressive agent.

In some embodiments, the immunosuppressive agent is a small molecule such as ibuprofen, acetaminophen, cyclosporine, tacrolimus, rapamycin, mycophenolate, cyclophosphamide, glucocorticoids, sirolimus, azathriopine, or methotrexate.

In some embodiments, the immunosuppressive agent is an antibody molecule, including but not limited to: muronomab (anti-CD3), Daclizumab (anti-IL12), Basiliximab, Infliximab (Anti-TNFa), or rituximab (Anti-CD20).

In some embodiments, co-administration of the fusosome composition with the immunosuppressive agent results in enhanced persistence of the fusosome composition in the subject compared to administration of the fusosome composition alone. In some embodiments, the enhanced persistence of the fusosome composition in the co-administration is at least 10%, 20%, 30%, 40%, 50%, 60%, 70%, 80%, 90% or longer, compared to persistence of the fusosome composition when administered alone. In some embodiments, the enhanced persistence of the fusosome composition in the co-administration is at least 1, 2, 3, 4, 5, 6, 7, 10, 15, 20, 25, or 30 days or longer, compared to survival of the fusosome composition when administered alone.

In some embodiments, the fusosome composition is used in combination with a gene therapy, e.g., a gene therapy that delivers a transgene of interest to a tissue of interest. In some embodiments, the fusosome composition comprises a payload gene encoding a binding moiety (e.g., a CAR molecule) that binds to the transgene or a fragment thereof. In some embodiments, the fusosome composition targets the binding moiety (e.g., a CAR molecule) for expression in Treg cells. Without wishing to be bound by theory, expressing the binding moiety (e.g., a CAR molecule) that binds to the transgene or a fragment thereof in Treg cells achieves immune tolerance to the transgene.

In some embodiments, the fusosome composition is co-administered with IL-2 (e.g., ultra-low dose of IL-2). In some embodiments, IL-2 is administered as described in, e.g., Matsuoka K, et al., Sci Transl Med (2013) 5 (179): 179ra143; Kennedy-Nasser A A, et al., Clin Cancer Res (2014) 20 (8): 2215-25; Koreth J, et al.; Blood (2016) 128 (1): 130-7, herein incorporated by reference in their entireties. In some embodiments, IL-2 is administered at, e.g., $10^4$-$10^7$ IU/$m^2$ (e.g., about $1\times10^5$, $2\times10^5$, $3\times10^5$, $4\times10^5$, $5\times10^5$, or $10^6$ IU/$m^2$) daily, e.g., for 6-12 weeks.

In some embodiments, the fusosome composition comprises a cytokine (e.g., IL-2 or IL-12), or a functional fragment thereof, on its surface and targets payload expression in Tregs.

EXAMPLES

The Examples below are set forth to aid in the understanding of the inventions, but are not intended to, and should not be construed to, limit its scope in any way.

Example 1. Assaying Off-Target Cells to Detect Specificity of Retroviral Nucleic Acid Delivery This Example describes quantification of a nucleic acid in off-target recipient cells by measuring vector copy number in single cells.

In an embodiment, treated mice have a similar vector copy number in off-target cells as those from untreated mice, e.g., no vector or a vector number similar to negative control levels. In an embodiment, treated mice have a similar percent of off-target cells that contain the vector as those from untreated mice, e.g., no cells or a cell number similar to negative control levels.

In this example, the off-target recipient cell is a CD11c+ cell. However, this protocol may be adapted to any cell type for which suitable surface markers exist and which can be isolated from the subject. Notably, the methods described herein may be equally applicable to humans, rats, monkeys with optimization to the protocol.

Mice are treated with retroviral vector produced as described herein or with PBS (negative control). 28 days following treatment, peripheral blood is collected from mice that received retroviral vector and mice that received PBS treatment. Blood is collected into 1 ml PBS containing 5 μM EDTA and mixed immediately to prevent clotting. The tubes are kept on ice and red blood cells are removed using a buffered ammonium chloride (ACK) solution. Cells are stained with a murine CD11c: APC-Cy7 antibody (Biolegend Catalog #: 117323) or an isotype control APC-Cy7 antibody (Biolegend Catalog #: 400230) at 4° C. for 30 minutes in the dark, after being Fc blocked (Biolegend Catalog #: 101319) in cell staining buffer (Biolegend Catalog #: 420201) for 10 minutes. After being washed two times with PBS, cells are analyzed on a FACSARIA™ (BD Biosciences, San Jose, CA.) with 640 nm laser excitation and emission collected at 780-/+60 nm running the FACSDiva™ software (BD Biosciences, San Jose, CA) to set negative gates using the isotype control APC-Cy7 antibody labeled cells. APC-Cy7 positive cells are sorted into single wells of plate for vector copy number analysis.

Vector copy number is assessed using single-cell nested PCR. PCR is performed with qPCR using primers and probes specific to the vector and an endogenous control gene. Vector copy number is determined by dividing the amount of vector qPCR signal by the amount of the endogenous control gene qPCR signal. A cell that received the vector will have a vector copy number of at least 1.0. Vector copy number is assessed across the population by averaging the vector copy number of the plurality of cells In some embodiments, mice treated with retroviral vectors have a similar average vector copy number in off-target cells as those from mice treated with vehicle. In some embodiments, mice treated with treated with retroviral vectors have a similar percent of off-target cells that received the vector as those from mice treated with vehicle.

Example 2. Assaying Off-Target Cells to Detect Specificity of Delivery of an Exogenous Protein Agent This Example describes quantification of the expression of an exogenous agent in off-target recipient cells by exogenous agent expression in single cells.

In an embodiment, treated mice have similar exogenous agent expression in off-target cells as those from untreated mice. In an embodiment, treated mice have a similar percent of off-target cells that express the exogenous agent as those from untreated mice.

In this example, the off-target recipient cell is a CD11c+ cell. However, this protocol may be adapted to any cell type for which suitable surface markers exist and which can be isolated from the subject. Notably, the methods described herein may be equally applicable to humans, rats, monkeys with optimization to the protocol. In this example the exogenous agent is a fluorescent protein and expression is measured via flow cytometry. In other embodiments, the expression of an exogenous protein agent may be measured with immunostaining for the protein. In other embodiments expression of the exogenous protein agent may be measured via microscopy or western blot.

Mice are treated with retroviral vector with a tdtomato fluorescent protein agent produced via any of the methods described in this application or with PBS (negative control). 28 days following treatment, peripheral blood is collected from mice that received retroviral vector and mice that received PBS treatment. Blood is collected into 1 ml PBS containing 5 μM EDTA and mixed immediately to prevent clotting. The tubes are kept on ice and red blood cells are removed using a buffered ammonium chloride (ACK) solution. Cells are stained with a murine CD11c: APC-Cy7 antibody (Biolgend Catalog #: 117323) or isotype controls APC-Cy7 antibody (Biolegend Catalog #: 400230) at 4° C. for 30 minutes in the dark, after being Fc blocked (Biolegend Catalog #: 101319) in cell staining buffer (Biolegend Catalog #: 420201) for 10 minutes. After being washed two times with PBS, cells are analyzed on a FACS Aria (BD Biosciences, San Jose, CA.) running the FACSDiva™ software (BD Biosciences, San Jose, CA). A negative gate for CD11c is set using the isotype control APC-Cy7 antibody labeled cells and with a 640 nm laser excitation and emission collected at 780−/+60. A negative gate for tdtomato expression is set with cells isolated from mice treated with vehicle and with a 552 nm laser excitation and an emission collected at 585−/+42 nm.

The percent of CD11c+ cells that are tdtomato positive is measured. In some embodiments, the percent of CD11c+ cells that are tdtomato positive is similar in cells from treated and untreated mice. The median tdtomato fluorescence level is measured in CD11c+ cells. In some embodiments, the median tdtomato fluorescence level in CD11c+ cells is similar in cells from treated and untreated mice.

Example 3. Assaying Target Cells to Detect Specificity of Retroviral Nucleic Acid Delivery This Example describes quantification of a nucleic acid in target recipient cells by measuring vector copy number in single cells.

In an embodiment, treated mice have a greater vector copy number in target cells than those from untreated mice. In an embodiment, treated mice have a greater percent of target cells that contain the vector than those from untreated mice.

In this example, the target recipient cell is a CD3+ cell. However, this protocol may be adapted to any cell type for which suitable surface markers exist and which can be isolated from the subject. Notably, the methods described herein may be equally applicable to humans, rats, monkeys with optimization to the protocol.

Mice are treated with retroviral vector and a blood sample is collected as described above in Example 1. Cells are stained with a murine CD3: APC-Cy7 antibody (Biolegend Catalog #: 100330) or an isotype control using the protocol described above in Example 1. Vector copy number is assessed using single-cell nested PCR as described in Example 1.

In some embodiments, mice treated with retroviral vectors have a greater average vector copy number in target cells than those from mice treated with vehicle. In some embodiments, mice treated with treated with retroviral vectors have a greater percent of target cells that received the vector than those from mice treated with vehicle.

Example 4. Assaying Target Cells to Detect Specificity of Delivery of an Exogenous Protein Agent This Example describes quantification of the expression of an exogenous protein agent in target recipient cells by exogenous protein agent expression in single cells.

In an embodiment, treated mice have greater exogenous protein agent expression in target cells than those from untreated mice. In an embodiment, treated mice have a greater percent of target cells that express the exogenous protein agent than those from untreated mice.

In this example, the target recipient cell is a CD3+ cell. However, this protocol may be adapted to any cell type for which suitable surface markers exist and which can be isolated from the subject. Notably, the methods described herein may be equally applicable to humans, rats, monkeys with optimization to the protocol. In this example the exogenous protein agent is a fluorescent protein and expression is measured via flow cytometry. In other embodiments, the expression of an exogenous protein agent may be measured with immunostaining for the protein. In other embodiments expression of the exogenous protein agent may be measured via microscopy or western blot.

Mice are treated with retroviral vector and a blood sample is collected as described above in Example 2. Cells are stained with a murine CD3: APC-Cy7 antibody (Biolegend Catalog #: 100330) or isotype controls and analyzed by flow cytometry using the protocol described in Example 2.

The percent of CD3+ cells that are tdtomato positive is measured. In some embodiments, the percent of CD3+ cells that are tdtomato positive is greater in cells from treated than untreated mice. The median tdtomato fluorescence level is measured in CD3+ cells. In some embodiments, the median tdtomato fluorescence level in CD3+ cells is greater in cells from treated than untreated mice.

Example 5. Modification of Retroviral Vector with HLA-G or HLA-E for Decreased Cytotoxicity Mediated by PBMC Cell Lysis This Example describes retroviral vectors derived from cells modified to have decreased cytotoxicity due to cell lysis by peripheral blood mononuclear cells (PBMCs).

In an embodiment, cytotoxicity mediated cell lysis of retroviral vectors by PBMCs is a measure of immunogenicity of retroviral vectors, as lysis will reduce, e.g., inhibit or stop, the activity of a retroviral vector.

Retroviral vectors are created from: unmodified cells (hereinafter NMCs, positive control), cells that are transfected with HLA-G or HLA-E cDNA (hereinafter NMC-HLA-G), and cells transfected with an empty vector control (hereinafter NMC-empty vector, negative control).

PBMC mediated lysis of a retroviral vector is determined by europium release assays as described in Bouma, et al. Hum. Immunol. 35 (2): 85-92; 1992 & van Besouw et al. Transplantation 70 (1): 136-143; 2000. PBMCs (hereinafter effector cells) are isolated from an appropriate donor, and stimulated with allogeneic gamma irradiated PMBCs and 200 IU/mL IL-2 (proleukin, Chiron BV Amsterdam, The Netherlands) in a round bottom 96 well plate for 7 days at 37° C. The retroviral vectors are labeled with europium-diethylenetriaminepentaacetate (DTPA) (sigma, St. Louis, MO, USA).

At day 7 cytotoxicity-mediated lysis assays is performed by incubating 63Eu-labelled retroviral vector with effector cells in a 96-well plate for 1, 2, 3, 4, 5, 6, 8, 10, 15, 20, 24, or 48 hours after plating at effector/target ratios ranging from 1000:1-1:1 and 1:1.25-1:1000. After incubation, the plates are centrifuged and a sample of the supernatant is transferred to 96-well plates with low background fluorescence (fluoroimmunoplates, Nunc, Roskilde, Denmark).

Subsequently, enhancement solution (PerkinElmer, Groningen, The Netherlands) is added to each well. The released europium is measured in a time-resolved fluorometer (Victor 1420 multilabel counter, LKB-Wallac, Finland). Fluorescence is expressed in counts per second (CPS). Maximum percent release of europium by a target retroviral vector is determined by incubating an appropriate number ($1\times10^2$-$1\times10^8$) of retroviral vectors with 1% TRITON™ (sigma-aldrich) for an appropriate amount of time. Spontaneous release of europium by target retroviral vector is measured by incubation of labeled target retroviral vector without effector cells. Percentage leakage is then calculated as: (spontaneous release/maximum release)×100%. The percentage of cytotoxicity mediated lysis is calculated as % lysis=[(measured lysis−spontaneous lysis−spontaneous release)/(maximum release−spontaneous release)]×100%. The data is analyzed by looking at the percentage of lysis as a function of different effector target ratios.

In an embodiment, retroviral vectors generated from NMC-HLA-G cells will have a decreased percentage of lysis by target cells at specific timepoints as compared to retroviral vectors generated from NMCs or NMC-empty vector.

Example 6. Modification of Retroviral Vector with HLA-G or HLA-E for Decreased NK Lysis Activity This Example describes the generation of a retroviral vector composition derived from a cell source which has been modified to decrease cytotoxicity mediated cell lysis by NK cells. In an embodiment cytotoxicity mediated cell lysis of retroviral vectors by NK cells is a measure of immunogenicity for retroviral vectors.

Retroviral vectors are created from: unmodified cells (hereinafter NMCs, positive control), cells that are transfected with HLA-G or HLA-E cDNA (hereinafter NMC-HLA-G), and cells transfected with an empty vector control (hereinafter NMC-empty vector, negative control).

NK cell mediated lysis of a retroviral vector is determined by europium release assays as described in Bouma, et al. Hum. Immunol. 35 (2): 85-92; 1992 & van Besouw et al. Transplantation 70 (1): 136-143; 2000. NK cells (hereinafter effector cells) are isolated from an appropriate donor according to the methods in Crop et al. Cell transplantation (20): 1547-1559; 2011, and stimulated with allogeneic gamma irradiated PMBCs and 200 IU/mL IL-2 (proleukin, Chiron BV Amsterdam, The Netherlands) in a round bottom 96 well plate for 7 days at 37° C. The retroviral vectors are labeled with europium-diethylenetriaminepentaacetate (DTPA) (sigma, St. Louis, MO, USA). Cytotoxicity-mediated lysis assays and data analysis are performed as described above in Example 5.

In an embodiment, retroviral vectors generated from NMC-HLA-G cells will have a decreased percentage of lysis by target cells at specific timepoints as compared to retroviral vectors generated from NMCs or NMC-empty vector.

Example 7. Modification of Retroviral Vector with HLA-G or HLA-E for Decreased CD8 Killer T Cell Lysis This Example describes the generation of a retroviral vector composition derived from a cell source which has been modified to decrease cytotoxicity mediated cell lysis by CD8+ T-cells. In an embodiment, cytotoxicity mediated cell lysis of retroviral vector by CD8+ T-cells is a measure of immunogenicity for retroviral vectors.

Retroviral vectors are created from: unmodified cells (hereinafter NMCs, positive control), cells that are transfected with HLA-G or HLA-E cDNA (hereinafter NMC-HLA-G), and cells transfected with an empty vector control (hereinafter NMC-empty vector, negative control).

CD8+ T cell mediated lysis of a retroviral vector is determined by europium release assays as described in Bouma, et al. Hum. Immunol. 35 (2): 85-92; 1992 & van Besouw et al. Transplantation 70 (1): 136-143; 2000. CD8+ T-cells (hereinafter effector cells) are isolated from an appropriate donor according to the methods in Crop et al. Cell transplantation (20): 1547-1559; 2011, and stimulated with allogeneic gamma irradiated PMBCs and 200 IU/mL IL-2 (proleukin, Chiron BV Amsterdam, The Netherlands) in a round bottom 96 well plate for 7 days at 37° C. The retroviral vectors are labeled with europium-diethylenetriaminepentaacetate (DTPA) (sigma, St. Louis, MO, USA). Cytotoxicity-mediated lysis assays and data analysis are performed as described above in Example 5.

In an embodiment, retroviral vectors generated from NMC-HLA-G cells will have a decreased percentage of lysis by target cells at specific timepoints as compared to retroviral vectors generated from NMCs or NMC-empty vector.

Example 8: Modification of Retroviral Vector with CD47 to Evade Macrophage Phagocytosis This Example describes quantification of the evasion of phagocytosis by modified retroviral vector. In an embodiment, modified retroviral vector will evade phagocytosis by macrophages.

Cells engage in phagocytosis, engulfing particles, enabling the sequestration and destruction of foreign invaders, like bacteria or dead cells. In some embodiments, phagocytosis of lentiviral vectors by macrophages would reduce their activity. In some embodiments, phagocytosis of lentiviral vectors is a measure of immunogenicity of retroviral vectors.

Retroviral vectors are produced from cells which lack CD47 (hereinafter NMC, positive control), cells that are transfected with CD47 cDNA (hereinafter NMC-CD47), and cells transfected with an empty vector control (hereinafter NMC-empty vector, negative control). Prior to retroviral vector production, the cells are labeled with CSFE.

Reduction of macrophage mediated immune clearance is determined with a phagocytosis assay according to the following protocol. Macrophages are plated immediately after harvest in confocal glass bottom dishes. Macrophages are incubated in DMEM+10% FBS+1% P/S for 1 h to attach. An appropriate number of retroviral vectors produced from NMC, NMC-CD47, NMC-empty vector are added to the macrophages as indicated in the protocol, and are incubated for 2 h, tools.thermofisher.com/content/sfs/manuals/mp06694.pdf.

After 2 h, the dish is gently washed and intracellular fluorescence is examined. Intracellular fluorescence emitted by engulfed retroviral particles is imaged by confocal microscopy at 488 excitation. The number of phagocytotic positive macrophage is quantified using imaging software. The data is expressed as the phagocytic index=(total number of engulfed cells/total number of counted macrophages)×(number of macrophages containing engulfed cells/total number of counted macrophages)×100.

In an embodiment, the phagocytic index will be reduced when macrophages are incubated with retroviral vectors derived from NMC-CD47, versus those derived from NMC, or NMC-empty vector.

Example 9: Modification of Retroviral Vector with Complement Regulatory Proteins to Evade Complement This Example describes quantification of complement activity against a retroviral vector using an in vitro assay. In some embodiments a modified retroviral vector described herein will have reduced complement activity compared to an unmodified retroviral vector.

In this Example, serum from a mouse is assessed for complement activity against a retroviral vector. The example measures the level of complement C3a, which is a central node in all complement pathways. The methods described herein may be equally applicable to humans, rats, monkeys with optimization to the protocol.

In this example, retroviral vectors are generated from HEK293 cells transfected with a cDNA coding for complement regulatory protein DAF (HEK293-DAF retroviral vector) or HEK 293 cells not expressing a complementary regulatory protein (HEK293 retroviral vector). In other embodiments, other complement regulatory proteins may be used, such as proteins that bind decay-accelerating factor (DAF, CD55), e.g. factor H (FH)-like protein-1 (FHL-1), e.g. C4b-binding protein (C4BP), e.g. complement receptor 1 (CD35), e.g. Membrane cofactor protein (MCP, CD46), eg. PROFECTIN™ (CD59), e.g. proteins that inhibit the classical and alternative complement pathway CD/C5 convertase enzymes, e.g. proteins that regulate MAC assembly.

Serum is recovered from naïve mice, mice that are administered HEK293-DAF retroviral vector, or mice that are administered HEK293 retroviral vector. Sera are collected from mice by collecting fresh whole blood and allowing it to clot completely for several hours. Clots are pelleted by centrifugation and the serum supernatants are removed. A negative control is heat inactivated mouse serum. Negative control samples are heated at 56 degrees Celsius for 1 hour. Serum may be frozen in aliquots.

The different retroviral vectors are tested for the dose at which 50% of cells in a target cell population receive the exogenous agent in the retroviral vector. The retroviral vector may contain any of the exogenous agents described herein. Many methods for assaying retroviral delivery of an exogenous agent to recipient cells are also described herein. In this particular example, the exogenous agent is Cre protein (encoded by the retroviral nucleic acid) and the target cells are RPMI8226 cells which stably-express a "LoxP-GFP-stop-LoxP-RFP" cassette under a CMV promoter, which upon recombination by Cre switches from GFP to RFP expression, as a marker of delivery. The identified dose at which 50% of the recipient cells are RFP positive is used for further experiments. In some embodiments, the identified dose at which 50% of recipient cells receive the exogenous agent will be similar across retroviral vectors.

Two-fold dilutions in phosphate-buffered saline (PBS, pH 7.4) of the retroviral vectors, starting at the dose of retroviral vectors at which 50% of the target cells receive the exogenous agent, are mixed with a 1:10 dilution of the sera from mice treated with the same retroviral vectors or naïve mice (assay volume, 20 μl) and incubated for 1 h at 37° C. The samples are further diluted 1:500 and used in an enzyme-linked immunosorbent assay (ELISA) specific for C3a. The ELISA is mouse complement C3a ELISA Kit product LS-F4210 sold by LifeSpan BioSciences Inc, which measures the concentration of C3a in a sample. The dose of retroviral vector at which 200 μg/ml of C3a is present is compared across sera isolated from mice.

In some embodiments, the dose of retroviral vector at which 200 μg/ml of C3a is present will be greater for HEK293-DAF retroviral vector incubated with HEK-293 DAF mouse sera than for HEK293 retroviral vector incubated with HEK293 mouse sera, indicating that complement activity targeting retroviral vector is greater in mice treated with HEK293 retroviral vector than HEK293-DAF retroviral vector. In some embodiments, the dose of retroviral vector at which 200 μg/ml of C3a is present will be greater for HEK293-DAF retroviral vector incubated with naive mouse sera than for HEK293 retroviral vector incubated with naive mouse sera, indicating that complement activity targeting retroviral vector is greater in mice treated with HEK293 retroviral vector than HEK293-DAF retroviral vector.

Example 10: Modification of Retroviral Vector to Knockdown Immunogenic Protein to Reduce Immunogenicity This Example describes the generation of a retroviral vector composition derived from a cell source which has been modified to reduce expression of a molecule which is immunogenic, and quantification of the reduced expression. In an embodiment, a retroviral vector can be derived from a cell source, which has been modified to reduce expression of a molecule which is immunogenic.

Therapies that stimulate an immune response can reduce the therapeutic efficacy or cause toxicity to the recipient. Thus, immunogenicity is an important property for a safe and effective therapeutic retroviral vectors. Expression of certain immune activating agents can create an immune response. MHC class I represents one example of an immune activating agent.

Retroviral vectors are produced from unmodified cells which normally express MHC-1 (hereinafter NMC, positive control), cells that are transfected with a DNA coding for a shRNA targeting MHC class I (hereinafter NMC-shMHC class I), and cells transfected with a DNA coding for non-targeted scrambled shRNA vector control (hereinafter NMC-vector control, negative control). Prior to retroviral production, the cells are labeled with CSFE.

Retroviral vectors are assayed for expression of MHC class I using flow cytometry. An appropriate number of retroviral vectors are washed and resuspended in PBS, held on ice for 30 minutes with 1:10-1:4000 dilution of fluorescently conjugated monoclonal antibodies against MHC class I (Harlan Sera-Lab, Belton, UK). Retroviral vectors are washed three times in PBS and resuspended in PBS. Non-specific fluorescence is determined, using equal aliquots of retroviral vector preparation incubated with and appropriate fluorescently conjugated isotype control antibody at equivalent dilutions. Retroviral vectors are assayed in a flow cytometer (FACSort, Becton-Dickinson) and the data is analyzed with flow analysis software (Becton-Dickinson).

The mean fluorescence data of the retroviral vectors derived from NMCs, NMC-shMHC class I, and NMC-vector control, is compared. In an embodiment, retroviral vectors derived from NMC-shMHC class I will have lower expression of MHC class I compared to NMCs and NMC-vector control.

Example 11: Measuring Pre-Existing Serum Inactivation of Retroviral Vectors

This Example describes quantification of pre-existing serum inactivation of retroviral vectors using an in vitro delivery assay.

In some embodiments, a measure of immunogenicity for retroviral vectors is serum inactivation. Serum inactivation of retroviral vectors may be due to antibody-mediated neutralization or complement mediated degradation. In an embodiment, some recipients of a retroviral vectors described herein will have factors in their serum which bind to and inactivate retroviral vectors.

In this Example, a retroviral vector naïve mouse is assessed for the presence of factors that inactivate retroviral vectors in serum. Notably, the methods described herein may be equally applicable to humans, rats, monkeys with optimization to the protocol.

The negative control is heat inactivated mouse serum and the positive control is serum derived from a mouse that has received multiple injections of retroviral vector generated from a xenogeneic source cell. Sera are collected from mice by collecting fresh whole blood and allowing it to clot completely for several hours. Clots are pelleted by centrifugation and the serum supernatants are removed. Negative control samples are heated at 56 degrees Celsius for 1 hour. Serum may be frozen in aliquots.

The retroviral vectors are tested for the dose at which 50% of cells in a target cell population receive the exogenous agent in the retroviral vector, as described above in Example 9. To assess serum inactivation of retroviral vectors, retroviral vectors are diluted 1:5 into normal or heat-inactivated serum (or medium containing 10% heat-inactivated FBS as the no-serum control) and the mixture is incubated at 37° C. for 1 h. Following the incubation, medium is added to the reaction for an additional 1:5 dilution and then serially diluted twice at a 1:10 ratio. Following this step, the retroviral vectors should be present at the previously identified dose at which 50% of the recipient cells have received the exogenous agent (e.g. are RFP positive).

Retroviral vectors that have been exposed to serum are then incubated with target cells. The percent of cells which receive the exogenous agent, and thus are RFP positive, is calculated. In some embodiments, the percent of cells which receive the exogenous agent will not be different between retroviral vector samples that have been incubated with serum and heat-inactivated serum from retroviral vector naïve mice, indicating that there is not serum inactivation of retroviral vector. In some embodiments, the percent of cells which receive the exogenous agent will not be different between retroviral vector samples that have been incubated with serum from retroviral vector naïve mice and no-serum control incubations, indicating that there is not serum inactivation of retroviral vectors. In some embodiments, the percent of cells which receive the exogenous agent will be less in retroviral vector samples that have been incubated with positive control serum than in retroviral vector samples that have been incubated with serum from retroviral vector naïve mice, indicating that there is not serum inactivation of retroviral vectors.

Example 12: Measuring Serum Inactivation of Retroviral Vectors after Multiple Administrations This Example describes quantification of serum inactivation of retroviral vectors using an in vitro delivery assay following multiple administrations of the retroviral vectors. In an embodiment, a modified retroviral vector, e.g., modified by a method described herein, will have a reduced (e.g., reduced compared to administration of an unmodified retroviral vector) serum inactivation following multiple (e.g., more than one, e.g., 2 or more) administrations of the modified retroviral vector. In an embodiment, a retroviral vector described herein will not be inactivated by serum following multiple administrations.

In some embodiments, a measure of immunogenicity for retroviral vector is serum inactivation. In an embodiment, repeated injections of a retroviral vector can lead to the development of anti-retroviral vector antibodies, e.g., antibodies that recognize retroviral vectors. In an embodiment, antibodies that recognize retroviral vectors can bind in a manner that can limit retroviral vector activity or longevity and mediate complement degradation.

In this Example, serum inactivation is examined after one or more administrations of retroviral vectors. Retroviral vectors are produced by any one of the previous Examples. In this example, retroviral are created from: cells that are transfected with HLA-G or HLA-E cDNA (hereinafter NMC-HLA-G), and cells transfected with an empty vector control (hereinafter NMC-empty vector, negative control). In some embodiments, retroviral vectors are derived from cells that are expressing other immunoregulatory proteins.

Serum is drawn from different cohorts: mice injected systemically and/or locally with 1, 2, 3, 5, or 10 injections of vehicle (retroviral vector naïve group), HEK293-HLA-G retroviral vector, or HEK293 retroviral vector. Sera are collected from mice by collecting fresh whole blood and allowing it to clot completely for several hours. Clots are pelleted by centrifugation and the serum supernatants are removed. A negative control is heat inactivated mouse serum. Negative control samples are heated at 56 degrees Celsius for 1 hour. Serum may be frozen in aliquots.

The retroviral vectors are tested for the dose at which 50% of cells in a target cell population receive the exogenous agent in the retroviral vector, as described above in Example 9.

To assess serum inactivation of retroviral vectors, retroviral vectors are exposed to serum and incubated with target cells as described in Example 11 above.

The percent of cells which receive the exogenous agent, and thus are RFP positive, is calculated. In some embodiments, the percent of cells which receive the exogenous agent will not be different between retroviral vector samples that have been incubated with serum and heat-inactivated serum from mice treated with HEK293-HLA-G retroviral vectors, indicating that there is not serum inactivation of retroviral vectors or an adaptive immune response. In some embodiments, the percent of cells which receive the exogenous agent will not be different between retroviral vector samples that have been incubated from mice treated 1, 2, 3, 5 or 10 times with HEK293-HLA-G retroviral vectors, indicating that there is not serum inactivation of retroviral vectors or an adaptive immune response. In some embodiments, the percent of cells which receive the exogenous agent will not be different between retroviral vector samples that have been incubated with serum from mice treated with vehicle and from mice treated with HEK293-HLA-G retroviral vectors, indicating that there is not serum inactivation of retroviral vectors or an adaptive immune response. In some embodiments, the percent of cells which receive the exogenous agent will be less for retroviral vectors derived from HEK293 than for HEK293-HLA-G retroviral vectors indicating that there is not serum inactivation of HEK293-HLA-G retroviral vectors or an adaptive immune response.

Example 13: Measuring Pre-Existing IgG and IgM Antibodies Reactive Against Retroviral Vectors This Example describes quantification of pre-existing anti-retroviral vector antibody titers measured using flow cytometry.

In some embodiments, a measure of immunogenicity for a retroviral vector is antibody responses. Antibodies that recognize retroviral vector can bind in a manner that can limit retroviral vector activity or longevity. In an embodiment, some recipients of a retroviral vector described herein will have pre-existing antibodies which bind to and recognize retroviral vector.

In this Example, anti-retroviral vector antibody titers are tested using retroviral vector produced using a xenogeneic source cell. In this Example, a retroviral vector naïve mouse is assessed for the presence of anti-retroviral vector antibodies. Notably, the methods described herein may be equally applicable to humans, rats, monkeys with optimization to the protocol.

The negative control is mouse serum which has been depleted of IgM and IgG, and the positive control is serum derived from a mouse that has received multiple injections of retroviral vector generated from a xenogeneic source cell.

To assess the presence of pre-existing antibodies which bind to retroviral vector, sera from retroviral vector-naïve mice is first decomplemented by heating to 56° C. for 30 min and subsequently diluted by 33% in PBS containing 3% FCS and 0.1% NaN3. Equal amounts of sera and retroviral vector ($1\times10^2$-$1\times10^8$ retroviral vectors per mL) suspensions are incubated for 30 min at 4° C. and washed with PBS through a calf-serum cushion.

IgM xenoreactive antibodies are stained by incubation of the retroviral vector with PE-conjugated goat antibodies specific for the Fc portion of mouse IgM (BD Bioscience) at 4° C. for 45 min. Notably, anti-mouse IgG1 or IgG2 secondary antibodies may also be used. Retroviral vector from all groups are washed twice with PBS containing 2% FCS and then analyzed on a FACS system (BD Biosciences). Fluorescence data are collected by use of logarithmic amplification and expressed as mean fluorescent intensity.

In an embodiment, the negative control serum will show negligible fluorescence comparable to the no serum or secondary alone controls. In an embodiment, the positive control will show more fluorescence than the negative control, and more than the no serum or secondary alone controls. In an embodiment, in cases where immunogenicity occurs, serum from retroviral vector-naïve mice will show more fluorescence than the negative control. In an embodiment, in cases where immunogenicity does not occur, serum from retroviral vector-naïve mice will show similar fluorescence compared to the negative control.

Example 14: Measuring IgG and IgM Antibody Responses after Multiple Administrations of Retroviral Vectors This Example describes quantification of the humoral response of a modified retroviral vector following multiple administrations of the modified retroviral vector. In an embodiment, a modified retroviral vector, e.g., modified by a method described herein, will have a reduced (e.g., reduced compared to administration of an unmodified retroviral vector) humoral response following multiple (e.g., more than one, e.g., 2 or more), administrations of the modified retroviral vector.

In some embodiments, a measure of immunogenicity for a retroviral vector is the antibody responses. In an embodiment, repeated injections of a retroviral vector can lead to the development of anti-retroviral vector antibodies, e.g., antibodies that recognize retroviral vector. In an embodiment, antibodies that recognize retroviral vector can bind in a manner that can limit retroviral vector activity or longevity.

In this Example, anti-retroviral vector antibody titers are examined after one or more administrations of retroviral vector. Retroviral vector is produced by any one of the previous Examples. In this example, retroviral are created from: cells that are not transfected with an immunomodulatory protein (NMCs), cells that are transfected with HLA-G or HLA-E cDNA (hereinafter NMC-HLA-G), and cells transfected with an empty vector control (hereinafter NMC-empty vector, negative control). In some embodiments, retroviral vectors are derived from cells that are expressing other immunoregulatory proteins.

Serum is drawn from different cohorts: mice injected systemically and/or locally with 1, 2, 3, 5, 10 injections of vehicle (retroviral vector naïve group), NMC retroviral vector, NMC-HLA-G retroviral vector, or NMC-empty vectors retroviral vector.

To assess the presence and abundance of anti-retroviral vector antibodies, sera from the mice is first decomplemented by heating to 56° C. for 30 min and subsequently diluted by 33% in PBS with 3% FCS and 0.1% NaN3. Equal amounts of sera and retroviral vector ($1\times10^2$-$1\times10^8$ retroviral vector per mL) are incubated for 30 min at 4° C. and washed with PBS through a calf-serum cushion.

Retroviral vector reactive IgM antibodies are stained by incubation of the retroviral vector with PE-conjugated goat antibodies specific for the Fc portion of mouse IgM (BD Bioscience) at 4° C. for 45 min. Notably, anti-mouse IgG1 or IgG2 secondary antibodies may also be used. Retroviral vector from all groups are washed twice with PBS containing 2% FCS and then analyzed on a FACS system (BD Biosciences). Fluorescence data are collected by use of logarithmic amplification and expressed as mean fluorescent intensity.

In an embodiment, NMC-HLA-G retroviral vectors will have decreased anti-viral IgM (or IgG1/2) antibody titers (as measured by fluorescence intensity on FACS) after injections, as compared to NMC retroviral vectors or NMC-empty retroviral vectors.

Example 15: Measuring IgG and IgM Titers Antibody Responses to Retroviral Vector Recipient Cells This Example describes quantification of antibody titers against recipient cells (cells that have fused with retroviral vectors) using flow cytometry. In some embodiments, a measure of the immunogenicity of recipient cells is the antibody response. Antibodies that recognize recipient cells can bind in a manner that can limit cell activity or longevity. In an embodiment, recipient cells will not be targeted by an antibody response, or an antibody response will be below a reference level.

In this Example, anti-recipient cell antibody titers in a subject (e.g., human, rat, or monkey) are tested. In addition, the protocol may be adapted to any cell type for which suitable surface markers exist. In this example, the target recipient cell is a CD3+ cell.

Mice are treated with retroviral vectors produced via any of the methods described in this application or with PBS (negative control) daily for 5 days. 28 days following the final treatment, peripheral blood is collected from mice that received retroviral vectors and mice that received PBS treatment. Blood is collected into 1 ml PBS containing 5 μM EDTA and mixed immediately to prevent clotting. The tubes are kept on ice and red blood cells are removed using a buffered ammonium chloride (ACK) solution. Cells are stained with a murine CD3-FITC antibody (Thermo Fisher Catalog #: 11-0032-82), at 4° C. for 30 minutes in the dark, after being blocked with bovine serum albumin for 10 minutes. After being washed two times with PBS, cells are analyzed on a LSR II (BD Biosciences, San Jose, CA) with 488 nm laser excitation and emission collected at 530+/−30 nm running the FACSDiva™ software (BD Biosciences, San Jose, CA). CD3+ cells are sorted.

The sorted CD3+ cells are then stained with IgM antibodies by incubation of the reaction mixture with PE-conjugated goat antibodies specific for the Fc portion of mouse IgM (BD Bioscience) at 4° C. for 45 min. Notably, anti-mouse IgG1 or IgG2 secondary antibodies may also be used. Cells from all groups are washed twice with PBS containing 2% FCS and then analyzed on a FACS system (BD Biosciences). Fluorescence data are collected by use of logarithmic amplification and expressed as mean fluorescent intensity. The mean fluorescence intensity is calculated for the sorted CD3 cells from mice treated with retroviral vectors and the mice treated with PBS.

A low mean fluorescence intensity is indicative of a low humoral response against the recipient cells. Mice treated with PBS are expected to have low mean fluorescence intensity. In an embodiment, the mean fluorescence intensity will be similar for recipient cells from mice treated with retroviral vectors and mice treated with PBS.

Example 16: Measuring Phagocytic Response to Retroviral Vector Recipient Cells

This Example describes quantification of macrophage response against recipient cells with a phagocytosis assay.

In some embodiments, a measure of the immunogenicity of recipient cells is the macrophage response. Macrophages engage in phagocytosis, engulfing cells and enabling the sequestration and destruction of foreign invaders, like bacteria or dead cells. In some embodiments, phagocytosis of recipient cells by macrophages would reduce their activity.

In an embodiment, recipient cells are not targeted by macrophages. In this Example, the macrophage response against recipient cells in a subject is tested. In addition, the protocol may be adapted to any cell type for which suitable surface markers exist. In this example, the target recipient cell is a CD3+ cell.

Mice are treated with retroviral vectors produced via any of the methods described in this application or with PBS (negative control) daily for 5 days. 28 days following the final treatment, peripheral blood is collected from mice that received retroviral vectors and mice that received PBS treatment. Blood is collected into 1 ml PBS containing 5 μM EDTA and mixed immediately to prevent clotting. The tubes are kept on ice and red blood cells are removed using a buffered ammonium chloride (ACK) solution.

Cells are stained with a murine CD3-FITC antibody (Thermo Fisher Catalog #: 11-0032-82), at 4° C. for 30 minutes in the dark, after being blocked with bovine serum albumin for 10 minutes. After being washed two times with PBS, cells are analyzed on a LSR II (BD Biosciences, San Jose, CA) with 488 nm laser excitation and emission collected at 530+/−30 nm running the FACSDiva™ software (BD Biosciences, San Jose, CA.). CD3+ cells are then sorted.

A phagocytosis assay is run to assess macrophage mediated immune clearance according to the following protocol. Macrophages are plated immediately after harvest in confocal glass bottom dishes. Macrophages are incubated in DMEM+10% FBS+1% P/S for 1 h to attach. An appropriate number of sorted and FITC-stained CD3+ cells derived from mice that received retroviral vectors and PBS are added to the macrophages as indicated in the protocol, and are incubated for 2 h, e.g., as described in the Vybrant™ Phagocytosis Assay Kit product information insert (Molecular Probes, revised 18 Mar. 2001, found at tools.thermofisher.com/content/sfs/manuals/mp06694.pdf).

After 2 h, the dish is gently washed and intracellular fluorescence is examined. To identify macrophages, cells are first incubated with Fc-receptor blocking antibody (eBioscence cat. no. 14-0161-86, clone 93) for 15 min on ice to block the binding of labeled mAbs to Fc receptors, which are abundantly expressed on macrophages. Following this step anti-F4/80-PE (ThermoFisher cat. No. 12-4801-82, clone BM8) and anti-CD11b-PerCP-Cy5.5 (BD Biosciences cat. No. 550993, clone M1/70) conjugated antibodies are added to stain macrophage surface antigens. Cells are incubated for 30 min in the dark at 4C followed by centrifugation and washing in PBS. The cells are then resuspended in PBS. Flow cytometry of samples is then performed and macrophages are identified via positive fluorescence signal for F4/80-PE and CD11b-PerCP-Cy5.5 using 533 nm and 647 nm laser excitation, respectively. After gating for macrophages, intracellular fluorescence emitted by engulfed recipient cells is assessed by 488 nm laser excitation. The number of phagocytotic positive macrophage is quantified using imaging software. The data is expressed as the phagocytic index=(total number of engulfed cells/total number of counted macrophages)×(number of macrophages containing engulfed cells/total number of counted macrophages)×100.

A low phagocytic index is indicative of low phagocytosis and targeting by macrophages. Mice treated with PBS are expected to have a low phagocytic index. In an embodiment, the phagocytic index will be similar for recipient cells derived from mice treated with retroviral vectors and mice treated with PBS.

Example 17: Measuring PBMC Response to Retroviral Vector Recipient Cells

This Example describes quantification of a PBMC response against recipient cells with a cell lysis assay.

In some embodiments, a measure of the immunogenicity of recipient cells is the PBMC response. In an embodiment, cytotoxicity mediated cell lysis of recipient cells by PBMCs is a measure of immunogenicity, as lysis will reduce, e.g., inhibit or stop, the activity of a retroviral vector.

In an embodiment, recipient cells do not elicit a PBMC response. In this Example, the PBMC response against recipient cells in a subject is tested.

In addition, the protocol may be adapted to any cell type for which suitable surface markers exist. In this example, the target recipient cell is a CD3+ cell.

Mice are treated with retroviral vector produced via any of the methods described in this application or with PBS (negative control) daily for 5 days. 28 days following the final treatment, peripheral blood is collected from mice that received retroviral vector and mice that received PBS treatment. Blood is collected into 1 ml PBS containing 5 μM EDTA and mixed immediately to prevent clotting. The tubes are kept on ice and red blood cells are removed using a buffered ammonium chloride (ACK) solution. Cells are stained with a murine CD3: APC-Cy7 antibody (Biolegend Catalog #: 100330) or an isotype control APC-Cy7 (IC: APC-Cy7) antibody (Biolegend Catalog #: 400230) at 4° C. for 30 minutes in the dark, after being Fc blocked (Biolegend Catalog #: 101319) in cell staining buffer (Biolegend Catalog #: 420201) for 10 minutes. After being washed two times with PBS, cells are analyzed on a FACS Aria (BD Biosciences, San Jose, CA.) with 640 nm laser excitation and emission collected at 780-/+60 nm running the FACS-Diva™ software (BD Biosciences, San Jose, CA) to set negative gates using the isotype control APC-Cy7 antibody labelled cells and then APC-Cy7 positive cells are sorted and collected. Sorted CD3+ cells are then labelled with either CellMask™ Green Plasma membrane Stain (CMG, ThermoFisher Catalog #: C37608) or DMSO as the negative control.

7 days prior to the isolation of CD3+ cells from the mice treated with retroviral vector or PBS, PBMCs are isolated from mice treated with retroviral vector or PBS according to the methods in Crop et al. Cell transplantation (20): 1547-1559; 2011 and simulated in the presence of IL-2 recombinant mouse protein (R&D Systems Catalog #: 402-ML-020) and CD3/CD28 beads (ThermoFisher Catalog #: 11456D) in a round bottom 96 well plate for 7 days at 37C. At day 7, the stimulated PBMCs are co-incubated with CD3+/CMG+ or CD3+/DMSO control cells for 1, 2, 3, 4, 5, 6, 8, 10, 15, 20, 24, 48 hours at a plating ratio of PBMC: CD3+/CMG+ or PBMC: CD3+/DMSO control cells ranging from 1000:1-1:1 and 1:1.25-1:1000. As a negative control a set of wells would receive CD3+/CMG+ and CD3+/DMSO control cells only, no PBMCs. After incubation, the plates are centrifuged and processed so that they are labelled with either murine CD3: APC-Cy7 antibody or an IC: APC-Cy7 antibody as per above. After being washed two times with PBS, cells are re-suspended in PBS and analyzed on a FACS Aria (APC-Cy7: 640 nm laser excitation/emission collected at 780-/+60 nm and CMG 561 nm laser excitation/emission collected at 585-/+16 nm) running the FACSDiva™ software (BD Biosciences, San Jose, CA). The FSC/SSC event data would then be used initially to set the gate for events labelled "cells". This "cells" gate would be then used to display events to set the PMT voltage for the the 640 nm and 561 nm laser analyzing samples labelled with IC: APC-Cy7/DMSO only. This sample would also be used to set the gates for negative cells for both APC-Cy7 and CMG. The CD3+/CMG+ cells that did not receive any PBMCs would then used to set the positive gates for CD3+ and CMG+ cells.

The data is analyzed by looking at the percentage of CD3+/CMG+ cells in the population of total cells. When comparing treatment groups, a relatively lower percentage of CD3+/CMG+ cells at any given assay ratio of PBMC: CD3+/CMG+ cells is indicative of recipient cell lysis. In an embodiment, the percent of CD3+/CMG+ will be similar for recipient cells derived from mice treated with retroviral vector and mice treated with PBS.

Example 18: Measuring NK Cell Response to Retroviral Vector Recipient Cells

This Example describes quantification of a natural killer cell response against recipient cells with a cell lysis assay.

In some embodiments, a measure of the immunogenicity of recipient cells is the natural killer cell response. In an embodiment, cytotoxicity mediated cell lysis of recipient cells by natural killer cells is a measure of immunogenicity, as lysis will reduce, e.g., inhibit or stop, the activity of a retroviral vector.

In an embodiment, recipient cells do not elicit a natural killer cell response. In this Example, the natural killer response against recipient cells in a subject is tested. In addition, the protocol may be adapted to any cell type for which suitable surface markers exist. In this example, the target recipient cell is a CD3+ cell.

Mice are treated with retroviral vector, a blood sample is drawn, and CD3+ cells are sorted as described above in Example 17. NK cells are isolated, cultured with the CD3+ cells, and analyzed by FACS according to the protocol described above in Example 17 except that NK cells are used in place of the PBMC cells used in Example 17.

The data is analyzed by looking at the percentage of CD3+/CMG+ cells in the population of total cells. When comparing treatment groups, a relatively lower percentage of CD3+/CMG+ cells at any given assay ratio of NK cells: CD3+/CMG+ cells is indicative of recipient cell lysis. In an embodiment, the percent of CD3+/CMG+will be similar for recipient cells derived from mice treated with retroviral vector and mice treated with PBS.

Example 19: Measuring CD8 T Cell Response to Retroviral Vector Recipient Cells This Example describes quantification of a CD8+ T cell response against recipient cells (cells that have fused with retroviral vectors) with a cell lysis assay.

In some embodiments, a measure of the immunogenicity of recipient cells is the CD8+ T cell response. In an embodiment, cytotoxicity mediated cell lysis of recipient cells by CD8+ T cells is a measure of immunogenicity, as lysis will reduce, e.g., inhibit or stop, the activity of a retroviral vector.

In an embodiment, recipient cells do not elicit a CD8+ T cell response. In this Example, the CD8+ T cell response against recipient cells in a subject is tested. In addition, the protocol may be adapted to any cell type for which suitable surface markers exist. In this example, the target recipient cell is a CD3+ cell.

Mice are treated with retroviral vector, a blood sample is drawn, and CD3+ cells are sorted as described above in Example 17. CD8+ T cells are isolated, cultured with the CD3+ cells, and analyzed by FACS according to the protocol described above in Example 17 except that CD8+ T cells are used in place of the PBMC cells used in Example 17.

The data is analyzed by looking at the percentage of CD3+/CMG+ cells in the population of total cells. When comparing treatment groups, a relatively lower percentage of CD3+/CMG+ cells at any given assay ratio of CD8+ cells: CD3+/CMG+ cells is indicative of recipient cell lysis. In an embodiment, the percent of CD3+/CMG+will be similar for recipient cells derived from mice treated with retroviral vectors and mice treated with PBS.

Example 20: Measuring T Cell-Specific Promoter Activity

This Example describes the measurement of the activity of a T cell-specific promoter (a positive TCSRE) in T cells compared to non-target cells.

The two cell types are cultured separately and treated with a retroviral vector produced as described herein. The retroviral vector is pseudotyped with a VSV-G and codes for tdtomato fluorescent protein reporter under the control of a T cell-specific promoter, e.g., a T cell-specific promoter of Table 3.

Two days after transduction, gene expression in the cells is measured via flow cytometry and the average vector copy number in the cells is measured with quantitative PCR. The median tdtomato gene expression per cell in the cell population is normalized to the population vector copy number.

In some embodiments, the population of T cells will have a greater ratio of tdtomato expression to vector copy number than the population of non-target cells. This will demonstrate that the T cell-specific promoter is more active in T cells.

Example 21: Measuring Change in Expression from Restrictive microRNA

This Example describes the measurement of the activity of a non-target-cell-restrictive microRNA (a NTCSRE) in T cells compared to non-target cells.

The two cell types are cultured separately and treated with a retroviral vector produced as described herein. The retroviral vector is pseudotyped with a VSV-G and codes for tdtomato fluorescent protein reporter under the control of a ubiquitously active promoter and a non-target-cell-restrictive microRNA, e.g., a microRNA of Table 4.

Two days after transduction, gene expression in the cells is measured via flow cytometry and the average vector copy number in the cells is measured with quantitative PCR. The median tdtomato gene expression per cell in the cell population is normalized to the population vector copy number.

In some embodiments, the population of T cells will have a greater ratio of tdtomato expression to vector copy number than the population of non-target cells. This will demonstrate that the non-target-cell restrictive microRNA decreases expression in non-target cells.

Example 22: Delivery of Chimeric Antigen Receptor to Treg In Vitro

This example describes delivery of a chimeric antigen receptor to Treg in vitro. In this example, the chimeric antigen receptor is specific for carcinoembryonic antigen (CEA).

A CEA-specific CAR is prepared based on the SCA431 scFv and including an extracellular mouse IgG hinge domain and intracellular CD28 and CD3zeta moieties. Splenocytes are obtained from mice and are transduced with a retroviral vector expressing the CAR, produced as described herein, or with PBS. The retroviral vector is pseudotyped with VSV-G and carries the chimeric antigen receptor gene under the control of a Treg-specific promoter (a positive TCSRE) and conventional CD4 cell restrictive microRNA sequence (a NTCSRE).

Following sufficient time for CAR expression, the cells are analyzed by flow cytometry. Expression of the CEA-specific CAR is detected by incubating the cells with soluble CEA followed by staining with an anti-CEA antibody. In some embodiments, the CEA-specific CAR will be detected in Treg cells, e.g., CD4+C25+ T cells expressing FoxP3.

Example 23: Treatment for Colitis In Vivo

This example describes delivery of a chimeric antigen receptor to Treg in vivo. In this example, the chimeric antigen receptor is specific for carcinoembryonic antigen (CEA).

Wild-type mice are treated with retroviral vector pseudotyped with VSV-G and carrying the CEA-CAR gene under the control of a Treg-specific promoter (a positive TCSRE) and conventional CD4 cell restrictive microRNA sequence (a NTCSRE). The retroviral vector is produced via any of the methods described in this application. Negative control mice are treated with PBS.

28 days following treatment, splenocytes are obtained from mice treated with retrovirus or PBS and stained for CAR expression as described in previous examples. In some embodiments, the level of CAR expression per cell will be higher in CD4+CD25+ splenocytes derived from mice treated with the retroviral vector encoding the CAR gene than in splenocytes treated with PBS.

In a separate experiment, colitis and colorectal cancer are induced in CEABAC-2 mice by a single i.p. injection of 7.5 mg/kg of the colon-specific carcinogen, AOM, followed by two 7-day cycles of 2% dextran sodium sulfate (DSS) in the drinking water, with 2 weeks of regular drinking water between cycles. Treatment with retrovirus is performed following the first cycle of DSS. Monitoring of colitis and colorectal tumors is performed under general anesthesia using an endoscopic system consisting of a miniature endoscope, a xenon light source, a high-definition camera and an air pump ("Coloview", Karl Storz, Tuttlingen, Germany). Evaluation of colitis and colorectal tumors is performed as described in Becker et al., 2005, Gut 54:950-954. In some embodiments, mice treated with retrovirus will display significantly decreased colitis and tumor scores as compared to mice treated with PBS.

Example 24: Lack of Transcriptional Activity in Fusosomes

This Example quantifies transcriptional activity in fusosomes compared to parent cells, e.g., source cells, used for fusosome generation. In an embodiment, transcriptional activity will be low or absent in fusosomes compared to the parent cells, e.g., source cells.

Fusosomes are a chassis for the delivery of therapeutic agent. Therapeutic agents, such as miRNA, mRNAs, proteins and/or organelles that can be delivered to cells or local tissue environments with high efficiency could be used to modulate pathways that are not normally active or active at pathological low or high levels in recipient tissue. In an embodiment, the observation that fusosomes are not capable of transcription, or that fusosomes have transcriptional activity of less than their parent cell, will demonstrate that removal of nuclear material has sufficiently occurred.

Fusosomes are prepared by any one of the methods described in previous Examples. A sufficient number of fusosomes and parent cells used to generate the fusosomes are then plated into a 6 well low-attachment multiwell plate in DMEM containing 20% Fetal Bovine Serum, 1× Penicillin/Streptomycin and the fluorescent-taggable alkyne-nucleoside EU for 1 hr at 37° C. and 5% CO2. For negative controls, a sufficient number of fusosomes and parent cells are also plated in multiwell plate in DMEM containing 20% Fetal Bovine Serum, 1× Penicillin/Streptomycin but with no alkyne-nucleoside EU.

After the 1 hour incubation the samples are processed following the manufacturer's instructions for an imaging kit (ThermoFisher Scientific). The cell and fusosome samples including the negative controls are washed thrice with 1×PBS buffer and resuspended in 1×PBS buffer and analyzed by flow cytometry (Becton Dickinson, San Jose, CA, USA) using a 488 nm argon laser for excitation, and the 530+/−30 nm emission. BD FACSDiva™ software was used for acquisition and analysis. The light scatter channels are set on linear gains, and the fluorescence channels on a logarithmic scale, with a minimum of 10,000 cells analyzed in each condition.

In an embodiment, transcriptional activity as measured by 530+/−30 nm emission in the negative controls will be null due to the omission of the alkyne-nucleoside EU. In some embodiments, the fusosomes will have less than about 70%, 60%, 50%, 40%, 30%, 20%, 10%, 5%, 4%, 3%, 2%, 1% or less transcriptional activity than the parental cells.

See also, Proc Natl Acad Sci USA, 2008 October 14; 105 (41): 15779-84. doi: 10.1073/pnas.0808480105. Epub 2008 Oct. 7.

Example 25: Lack of DNA Replication or Replication Activity

This Example quantifies DNA replication in fusosomes. In an embodiment, fusosomes will replicate DNA at a low rate compared to cells.

Fusosomes are prepared by any one of the methods described in previous Examples. Fusosome and parental cell DNA replication activity is assessed by incorporation of a fluorescent-taggable nucleotide (ThermoFisher Scientific #C10632). Fusosomes and an equivalent number of cells are incubated with EdU at a final concentration of 10 μM for 2 hr, after preparation of an EdU stock solution with in dimethylsulfoxide. The samples are then fixed for 15 min using 3.7% PFA, washed with 1×PBS buffer, pH 7.4 and permeabilized for 15 min in 0.5% detergent solution in 1×PBS buffer, pH 7.4.

After permeabilization, fusosomes and cells in suspension in PBS buffer containing 0.5% detergent are washed with 1×PBS buffer, pH 7.4 and incubated for 30 min at 21° C. in reaction cocktail, 1×PBS buffer, CuSO4 (Component F), azide-fluor 488, 1× reaction buffer additive.

A negative control for fusosome and cell DNA replication activity is made with samples treated the same as above but with no azide-fluor 488 in the 1× reaction cocktail.

The cell and fusosome samples are then washed and resuspended in 1×PBS buffer and analyzed by flow cytometry. Flow cytometry is done with a FACS cytometer (Becton Dickinson, San Jose, CA, USA) with 488 nm argon laser excitation, and a 530+/−30 nm emission spectrum is collected. FACS analysis software is used for acquisition and analysis. The light scatter channels are set on linear gains, and the fluorescence channels on a logarithmic scale, with a minimum of 10,000 cells analyzed in each condition. The relative DNA replication activity is calculated based on the median intensity of azide-fluor 488 in each sample. All events are captured in the forward and side scatter channels (alternatively, a gate can be applied to select only the fusosome population). The normalized fluorescence intensity value for the fusosomes is determined by subtracting from the median fluorescence intensity value of the fusosome the median fluorescence intensity value of the respective negative control sample. Then the normalized relative DNA replication activity for the fusosomes samples is normalized to the respective nucleated cell samples in order to generate quantitative measurements for DNA replication activity.

In an embodiment, fusosomes have less DNA replication activity than parental cells. See, also, Salic, 2415-2420, doi:10.1073/pnas.0712168105.

Example 26: Quantification of Fusogens

This example describes quantification of the absolute number of fusogens per fusosome. A fusosome composition is produced by any one of the methods described in the previous Examples, except the fusosome is engineered as described in a previous Example to express a fusogen (VSV-G) tagged with GFP. In addition, a negative control fusosome is engineered with no fusogen (VSV-G) or GFP present.

The fusosomes with the GFP-tagged fusogen and the negative control(s) are then assayed for the absolute number of fusogens as follows. Commercially acquired recombinant GFP is serially diluted to generate a calibration curve of protein concentration. The GFP fluorescence of the calibration curve and a sample of fusosomes of known quantity is then measured in a fluorimeter using a GFP light cube (469/35 excitation filter and a 525/39 emission filter) to calculate the average molar concentration of GFP molecules in the fusosome preparation. The molar concentration is then converted to the number of GFP molecules and divided by the number of fusosomes per sample to achieve an average number of GFP-tagged fusogen molecules per fusosome and thus provides a relative estimate of the number of fusogens per fusosome.

In an embodiment, GFP fluorescence will be higher in the fusosomes with GFP tag as compared to the negative controls, where no fusogen or GFP is present. In an embodiment, GFP fluorescence is relative to the number of fusogen molecules present.

Alternatively, individual fusosomes are isolated using a single cell prep system (FLUIDIGM™) per manufacturer's instructions, and qRT-PCR is performed using a commercially available probeset (TAQMAN™) and master mix designed to quantify fusogen or GFP cDNA levels based upon the $C_t$ value. A RNA standard of the same sequence as the cloned fragment of the fusogen gene or the GFP gene is generated by synthesis (Amsbio) and then added to single cell prep system qRT-PCR experimental reaction in serial dilutions to establish a standard curve of $C_t$ vs concentration of fusogen or GFP RNA.

The $C_t$ value from fusosomes is compared to the standard curve to determine the amount of fusogen or GFP RNA per fusosome.

In an embodiment, fusogen and GFP RNA will be higher in the fusosomes with engineered to express the fusogens as compared to the negative controls, where no fusogen or GFP is present.

Fusogens may further be quantified in the lipid bilayer by analyzing the lipid bilayer structure as previously described and quantifying fusogens in the lipid bilayer by LC-MS as described in other Examples herein.

Example 27: Measuring the Average Size of Fusosomes

This Example describes measurement of the average size of fusosomes.

Fusosomes are prepared by any one of the methods described in previous Examples. The fusosomes measured to determine the average size using commercially available systems (iZON Science). The system is used with software according to manufacturer's instructions and a nanopore designed to analyze particles within the 40 nm to 10 μm size range. Fusosomes and parental cells are resuspended in phosphate-buffered saline (PBS) to a final concentration range of 0.01-0.1 μg protein/mL. Other instrument settings are adjusted as indicated in the following table:

TABLE 6

Fusosome measurement parameters and settings

| Measurement Parameter | Setting |
|---|---|
| Pressure | 6 |
| Nanopore type | NP300 |
| Calibration sample | CPC400_6P |
| Gold standard analysis | no |
| Capture assistant | none |

All fusosomes are analyzed within 2 hours of isolation. In an embodiment, the fusosomes will have a size within about 1%, 2%, 3%, 4%, 5%, 10%, 20%, 30%, 40%, 50%, 60%, 70%, 80%, 90%, or greater than the parental cells.

Example 28: Measuring the Average Size Distribution of Fusosomes

This Example describes measurement of the size distribution of fusosomes.

Fusosomes are generated by any one of the methods described in previous Examples, and are tested to determine the average size of particles using a commercially available system, such as described in a previous Example. In an embodiment, size thresholds for 10%, 50%, and 90% of the fusosomes centered around the median are compared to parental cells to assess fusosome size distribution.

In an embodiment, the fusosomes will have less than about 90%, 80%, 70%, 60%, 50%, 40%, 30%, 20%, 10%, 5%, or less of the parental cell's variability in size distribution within 10%, 50%, or 90% of the sample.

Example 29: Average Volume of Fusosomes

This example describes measurement of the average volume of fusosomes. Without wishing to be bound by theory, varying the size (e.g., volume) of fusosomes can make them versatile for distinct cargo loading, therapeutic design or application.

Fusosomes are prepared as described in previous Examples. The positive control is HEK293 cells or polystyrene beads with a known size. The negative control is HEK293 cells that are passed through a 36 gauge needle approximately 50 times.

Analysis with a transmission electron microscope, as described in a previous Example, is used to determine the size of the fusosomes. The diameter of the fusosome is measured and volume is then calculated.

In an embodiment, fusosomes will have an average size of approximately 50 nm or greater in diameter.

Example 30: Average Density of Fusosomes

Fusosome density is measured via a continuous sucrose gradient centrifugation assay as described in Théry et al., Curr Protoc Cell Biol. 2006 April; Chapter 3: Unit 3.22. Fusosomes are obtained as described in previous Examples.

First, a sucrose gradient is prepared. A 2 M and a 0.25 sucrose solution are generated by mixing 4 ml HEPES/sucrose stock solution and 1 ml HEPES stock solution or 0.5 ml HEPES/sucrose stock solution and 4.5 ml HEPES stock solution, respectively. These two fractions are loaded into the gradient maker with all shutters closed, the 2 M sucrose solution in the proximal compartment with a magnetic stir bar, and the 0.25 M sucrose solution in the distal compartment. The gradient maker is placed on a magnetic stir plate, the shutter between proximal and distal compartments is opened and the magnetic stir plate is turned on. HEPES stock solution is made as follows: 2.4 g N-2-hydroxyethylpiperazine-N'-2-ethanesulfonic acid (HEPES; 20 mMfinal), 300 H2O, adjust pH to 7.4 with 10 N NaOH and finally adjust volume to 500 ml with $H_2O$. HEPES/sucrose stock solution is made as follows: 2.4 g hydroxyethylpiperazine-N'-2-ethanesulfonic acid (HEPES; 20 mM final), 428 g protease-free sucrose (ICN; 2.5 M final), 150 ml H2O, adjust pH to 7.4 with 10 N NaOH and finally adjust volume to 500 ml with $H_2O$.

The fusosomes are resuspended in 2 ml of HEPES/sucrose stock solution and are poured on the bottom of an SW 41 centrifuge tube. The outer tubing is placed in the SW 41 tube, just above the 2 ml of fusosomes. The outer shutter is opened, and a continuous 2 M (bottom) to 0.25 M (top) sucrose gradient is slowly poured on top of the fusosomes. The SW 41 tube is lowered as the gradient is poured, so that the tubing is always slightly above the top of the liquid.

All tubes with gradients are balanced with each other, or with other tubes having the same weight of sucrose solutions. The gradients are centrifuged overnight (>14 hr) at 210,000×g, 4° C., in the SW 41 swinging-bucket rotor with the brake set on low.

With a micropipettor, eleven 1-ml fractions, from top to bottom, are collected and placed in a 3-ml tube for the TLA-100.3 rotor. The samples are set aside and, in separate wells of a 96-well plate, 50 μl of each fraction is used to measure the refractive index. The plate is covered with adhesive foil to prevent evaporation and stored for no more than 1 hour at room temperature. A refractometer is used to measure the refractive index (hence the sucrose concentration, and the density) of 10 to 20 μl of each fraction from the material saved in the 96-well plate.

A table for converting the refractive index into g/ml is available in the ultracentrifugation catalog downloadable from the Beckman website.

Each fraction is then prepared for protein content analysis. Two milliliters of 20 mM HEPES, pH 7.4, is added to each 1-ml gradient fraction, and mixed by pipetting up and down two to three times. One side of each tube is marked with a permanent marker, and the tubes are placed marked side up in a TLA-100.3 rotor.

The 3 ml-tubes with diluted fractions are centrifuged for 1 hr at 110,000×g, 4° C. The TLA-100.3 rotor holds six tubes, so two centrifugations for each gradient is performed with the other tubes kept at 4° C. until they can be centrifuged.

The supernatant is aspirated from each of the 3-ml tubes, leaving a drop on top of the pellet. The pellet most probably is not visible, but its location can be inferred from the mark on the tube. The invisible pellet is resuspended and transferred to microcentrifuge tubes. Half of each resuspended fraction is used for protein contentment analysis by bicinchoninic acid assay, described in another Example. This provides a distribution across the various gradient fractions of the fusosome preparation. This distribution is used to determine the average density of the fusosomes. The second half volume fraction is stored at −80° C. and used for other purposes (e.g. functional analysis, or further purification by immunoisolation) once protein analysis has revealed the fusosome distribution across fractions.

In an embodiment, using this assay, the average density of the fusosomes will be 1.25 g/ml+/−0.05 standard deviation. In an embodiment, the average density of the fusosomes will be in the range of 1-1.1, 1.05-1.15, 1.1-1.2, 1.15-1.25, 1.2-1.3, or 1.25-1.35. In an embodiment, the average density of the fusosomes will be less than 1 or more than 1.35.

Example 31: Measuring Nuclear Envelope Content

This Example describes a measurement of the nuclear envelope content in enucleated fusosomes. The nuclear envelope isolates DNA from the cytoplasm of the cell.

In an embodiment, a purified fusosome composition comprises a mammalian cell, such as HEK-293 Ts (293 [HEK-293] (ATCC® CRL-1573™), that has been enucleated as described herein. This Example describes the quantification of different nuclear membrane proteins as a proxy to measure the amount of intact nuclear membrane that remains after fusosome generation.

In this Example, $10\times10^6$ HEK-293 Ts and the equivalent amount of fusosomes prepared from $10\times10^6$ HEK-293 Ts are fixed for 15 min using 3.7% PFA, washed with 1×PBS buffer, pH 7.4 and permeabilized simultaneously, and then blocked for 15 min using 1×PBS buffer containing 1% Bovine Serum Albumin and 0.5% TRITON™ X-100, pH 7.4. After permeabilization, fusosomes and cells are incubated for 12 hours at 4° C. with different primary antibodies, e.g. (anti-RanGAP1 antibody [EPR3295] (ABCAM™-ab92360), anti-NUP98 antibody [EPR6678]-nuclear pore marker (ABCAM™-ab124980), anti-nuclear pore complex proteins antibody [Mab414]-(ABCAM™-ab24609), anti-importin 7 antibody (ABCAM™-ab213670), at manufacturer suggested concentrations diluted in 1×PBS buffer containing 1% bovine serum albumin and 0.5% TRITON™ X-100, pH 7.4. Fusosomes and cells are then washed with 1×PBS buffer, pH 7.4, and incubated for 2 hr at 21° C. with an appropriate fluorescent secondary antibody that detects the previous specified primary antibody at manufacturer suggested concentrations diluted in 1×PBS buffer containing 1% bovine serum albumin and 0.5% detergent, pH 7.4. Fusosomes and cells are then washed with 1×PBS buffer, re-suspended in 300 μL of 1×PBS buffer, pH 7.4 containing 1 μg/ml Hoechst 33342, filtered through a 20 μm FACS tube and analyzed by flow cytometry.

Negative controls are generated using the same staining procedure but with no primary antibody added. Flow cytometry is performed on a FACS cytometer (Becton Dickinson, San Jose, CA, USA) with 488 nm argon laser excitation, and a 530+/−30 nm emission spectrum is collected. FACS acquisition software is used for acquisition and analysis. The light scatter channels are set on linear gains, and the fluorescence channels on a logarithmic scale, with a minimum of 10,000 cells analyzed in each condition. The relative intact nuclear membrane content is calculated based on the median intensity of fluorescence in each sample. All events are captured in the forward and side scatter channels.

The normalized fluorescence intensity value for the fusosomes is determined by subtracting from the median fluorescence intensity value of the fusosome the median fluorescence intensity value of the respective negative control sample. Then the normalized fluorescence for the fusosomes samples is normalized to the respective nucleated cell samples in order to generate quantitative measurements of intact nuclear membrane content.

In an embodiment, enucleated fusosomes will comprise less than 1%, 2%, 3%, 4%, 5%, 10%, 20%, 30%, 40%, 50%, 60%, 70%, 80%, or 90% fluorescence intensity or nuclear envelope content compared to the nucleated parental cells.

Example 32: Measuring Chromatin Levels

This Example describes measurement of chromatin in enucleated fusosomes.

DNA can be condensed into chromatin to allow it to fit inside the nucleus. In an embodiment, a purified fusosome composition as produced by any one of the methods described herein will comprise low levels of chromatin.

Enucleated fusosomes prepared by any of the methods previously described and positive control cells (e.g., parental cells) are assayed for chromatin content using an ELISA with antibodies that are specific to histone protein H3 or histone protein H4. Histones are the chief protein component of chromatin, with H3 and H4 the predominant histone proteins.

Histones are extracted from the fusosome preparation and cell preparation using a commercial kit (e.g. ABCAM™ Histone Extraction Kit (ab113476)) or other methods known in the art. These aliquots are stored at −80 C until use. A serial dilution of standard is prepared by diluting purified histone protein (either H3 or H4) from 1 to 50 ng/ul in a solution of the assay buffer. The assay buffer may be derived from a kit supplied by a manufacturer (e.g. ABCAM™ Histone H4 Total Quantification Kit (ab156909) or ABCAM™ Histone H3 total Quantification Kit (ab115091)). The assay buffer is added to each well of a 48- or 96-well plate, which is coated with an anti-histone H3 or anti-H4 antibody and sample or standard control is added to the well to bring the total volume of each well to 50 μl. The plate is then covered and incubated at 37 degrees for 90 to 120 minutes.

After incubation, any histone bound to the anti-histone antibody attached to the plate is prepared for detection. The supernatant is aspirated and the plate is washed with 150 μl of wash buffer. The capture buffer, which includes an anti-histone H3 or anti-H4 capture antibody, is then added to the plate in a volume of 50 μl and at a concentration of 1 μg/mL. The plate is then incubated at room temperature on an orbital shaker for 60 minutes.

Next, the plate is aspirated and washed 6 times using wash buffer. Signal reporter molecule activatable by the capture antibody is then added to each well. The plate is covered and incubated at room temperature for 30 minutes. The plate is then aspirated and washed 4 times using wash buffer. The reaction is stopped by adding stop solution. The absorbance of each well in the plate is read at 450 nm, and the concentration of histones in each sample is calculated according to the standard curve of absorbance at 450 nm vs. concentration of histone in standard samples.

In an embodiment, fusosome samples will comprise less than 1%, 2%, 3%, 4%, 5%, 10%, 20%, 30%, 40%, 50%, 60%, 70%, 80%, or 90% the histone concentration of the nucleated parental cells.

Example 33: Measuring miRNA Content in Fusosomes

This example describes quantification of microRNAs (miRNAs) in fusosomes. In an embodiment, a fusosome comprises miRNAs.

MiRNAs are regulatory elements that, among other activities, control the rate by which messenger RNAs (mRNAs) are translated into proteins. In an embodiment, fusosomes carrying miRNA may be used to deliver the miRNA to target sites.

Fusosomes are prepared by any one of the methods described in previous Examples. RNA from fusosomes or parental cells is prepared as described previously. At least one miRNA gene is selected from the Sanger Center miRNA Registry at sanger.ac.uk/Software/Rfam/mirna/index.shtml. miRNA is prepared as described in Chen et al, *Nucleic Acids Research,* 33 (20), 2005. All TAQMAN™ miRNA assays are available through Thermo Fisher (A25576, Waltham, MA).

qPCR is carried out according to manufacturer's specifications on miRNA cDNA, and CT values are generated and analyzed using a real-time PCR system as described herein.

In an embodiment, the miRNA content of fusosomes will be at least 1%, 2%, 3%, 4%, 5%, 10%, 20%, 30%, 40%, 50%, 60%, 70%, 80%, 90%, or greater than that of their parental cells.

Example 34: Quantifying Expression of an Endogenous RNA or Synthetic RNA in Fusosomes This example describes quantification of levels of endogenous RNA with altered expression, or a synthetic RNA that is expressed in a fusosome.

The fusosome or parental cell is engineered to alter the expression of an endogenous or synthetic RNA that mediates a cellular function to the fusosomes.

Transposase vectors (System Biosciences, Inc.) includes the open reading frame of the Puromycin resistance gene together with an open reading frame of a cloned fragment of a protein agent. The vectors are electroporated into 293 Ts using an electroporator (Amaxa) and a 293T cell line specific nuclear transfection kit (Lonza).

Following selection with puromycin for 3-5 days in DMEM containing 20% Fetal Bovine Serum and 1× Penicillin/Streptomycin, fusosomes are prepared from the stably expressing cell line by any one of the methods described in previous Examples.

Individual fusosomes are isolated and protein agent or RNA per fusosome is quantified as described in a previous Example.

In an embodiment, the fusosomes will have at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, or more of the RNA per fusosome.

Example 35: Measuring Proteomic Composition in Fusosomes

This Example describes quantification of the protein composition of fusosomes. In an embodiment, the protein composition of fusosomes will be similar to the cells that they are derived from.

Fusosomes are prepared by any one of the methods described in previous Examples. Fusosomes are resuspended in lysis buffer (7M Urea, 2M Thiourea, 4% (w/v) Chaps in 50 mM Tris pH 8.0) and incubated for 15 minutes at room temperature with occasional vortexing. Mixtures are then lysed by sonication for 5 minutes in an ice bath and spun down for 5 minutes at 13,000 RPM. Protein content is determined by a colorimetric assay (Pierce) and protein of each sample is transferred to a new tube and the volume is equalized with 50 mM Tris pH 8.

Proteins are reduced for 15 minutes at 65 Celsius with 10 mM DTT and alkylated with 15 mM iodoacetamide for 30 minutes at room temperature in the dark. Proteins are precipitated with gradual addition of 6 volumes of cold (−20 Celsius) acetone and incubated overnight at −80 Celsius. Protein pellets are washed 3 times with cold (−20 Celsius) methanol. Proteins are resuspended in 50 mM Tris pH 8.3.

Next, trypsin/lysC is added to the proteins for the first 4 h of digestion at 37 Celsius with agitation. Samples are diluted with 50 mM Tris pH 8 and 0.1% sodium deoxycholate is added with more trypsin/lysC for digestion overnight at 37 Celsius with agitation. Digestion is stopped and sodium deoxycholate is removed by the addition of 2% v/v formic acid. Samples are vortexed and cleared by centrifugation for 1 minute at 13,000 RPM. Peptides are purified by reversed phase solid phase extraction (SPE) and dried down. Samples are reconstituted in 20 µl of 3% DMSO, 0.2% formic acid in water and analyzed by LC-MS.

To have quantitative measurements, a protein standard is also run on the instrument. Standard peptides (Pierce, equimolar, LC-MS grade, #88342) are diluted to 4, 8, 20, 40 and 100 fmol/ul and are analyzed by LC-MS/MS. The average AUC (area under the curve) of the 5 best peptides per protein (3 MS/MS transition/peptide) is calculated for each concentration to generate a standard curve.

Acquisition is performed with a high resolution mass spectrometer (AB SCIEX™, Foster City, CA, USA) equipped with an electrospray interface with a 25 µm iD capillary and coupled with micro-ultrahigh performance liquid chromatography (uUHPLC) (Eksigent, Redwood City, CA, USA). Analysis software is used to control the instrument and for data processing and acquisition. The source voltage is set to 5.2 kV and maintained at 225° C., curtain gas is set at 27 psi, gas one at 12 psi and gas two at 10 psi. Acquisition is performed in Information Dependent Acquisition (IDA) mode for the protein database and in SWATH acquisition mode for the samples. Separation is performed on a reversed phase column 0.3 µm i.d., 2.7 µm particles, 150 mm long (Advance Materials Technology, Wilmington, DE) which is maintained at 60° C.

Samples are injected by loop overfilling into a 5 µL loop. For the 120 minute (samples) LC gradient, the mobile phase includes the following: solvent A (0.2% v/v formic acid and 3% DMSO v/v in water) and solvent B (0.2% v/v formic acid and 3% DMSO in EtOH) at a flow rate of 3 µL/min.

For the absolute quantification of the proteins, a standard curve (5 points, R2>0.99) is generated using the sum of the AUC of the 5 best peptides (3 MS/MS ion per peptide) per protein. To generate a database for the analysis of the samples, the DIAUmpire algorithm is run on each of the 12 samples and combined with the output MGF files into one database. This database is used with software (AB SCIEX™) to quantify the proteins in each of the samples, using 5 transition/peptide and 5 peptide/protein maximum. A peptide is considered as adequately measured if the score computed is superior to 1.5 or had a FDR <1%. The sum of the AUC of each of the adequately measured peptides is mapped on the standard curve, and is reported as fmol.

The resulting protein quantification data is then analyzed to determine protein levels and proportions of known classes of proteins as follows: enzymes are identified as proteins that are annotated with an Enzyme Commission (EC) number; ER associated proteins are identified as proteins that had a Gene Ontology (GO; geneontology.org) cellular compartment classification of ER and not mitochondria; exosome associated proteins are identified as proteins that have a Gene Ontology cellular compartment classification of exosomes and not mitochondria; and mitochondrial proteins are identified as proteins that are identified as mitochondrial in the MitoCarta database (Calvo et al., NAR 20151 doi: 10.1093/nar/gkv1003). The molar ratios of each of these categories are determined as the sum of the molar quantities of all the proteins in each class divided by the sum of the molar quantities of all identified proteins in each sample.

Fusosome proteomic composition is compared to parental cell proteomic composition. In an embodiment, a similar proteomic compositions between fusosomes and parental cells will be observed when >50% of the identified proteins are present in the fusosome, and of those identified proteins the level is >25% of the corresponding protein level in the parental cell.

Example 36: Measuring GAPDH in Fusosomes

This assay describes quantification of the level of glyceraldehyde 3-phosphate dehydrogenase (GAPDH) in the fusosomes, and the relative level of GAPDH in the fusosomes compared to the parental cells.

GAPDH is measured in the parental cells and the fusosomes using a standard commercially available ELISA for GAPDH (ab176642,ABCAM™) per the manufacturer's directions.

Total protein levels are similarly measured via bicinchoninic acid assay as previously described in the same volume of sample used to measure GAPDH. In embodiments, using this assay, the level of GAPDH per total protein in the fusosomes will be <100 ng GAPDH/ug total protein. Similarly, in embodiments, the decrease in GAPDH levels relative to total protein from the parental cells to the fusosomes will be greater than a 10% decrease.

In an embodiment, GAPDH content in the preparation in ng GAPDH/ug total protein will be less than 500, less than 250, less than 100, less than 50, less than 20, less than 10, less than 5, or less than 1.

In an embodiment, the decrease in GAPDH per total protein in ng/ug from the parent cell to the preparation will be more than 1%, more than 2.5%, more than 5%, more than 10%, more than 15%, more than 20%, more than 30%, more than 40%, more than 50%, more than 60%, more than 70%, more than 80%, or more than 90%.

Example 37: Measuring Calnexin in Fusosomes

This assay describes quantification of the level of calnexin (CNX) in the fusosomes, and the relative level of CNX in the fusosomes compared to the parental cells.

Calnexin is measured in the starting cells and the preparation using a standard commercially available ELISA for calnexin (MBS721668, MyBioSource) per the manufacturer's directions.

Total protein levels are similarly measured via bicinchoninic acid assay as previously described in the same volume of sample used to measure calnexin. In embodiments, using this assay, the level of calnexin per total protein in the fusosomes will be <100 ng calnexin/ug total protein. Similarly, in embodiments, the increase in calnexin levels relative to total protein from the parental cell to the fusosomes will be greater than a 10% increase.

In an embodiment, calnexin content in the preparation in ng calnexin/ug total protein will be less than 500, 250, 100, 50, 20, 10, 5, or 1.

In an embodiment, the decrease in calnexin per total protein in ng/ug from the parent cell to the preparation will be more than 1%, 2.5%, 5%, 10%, 15%, 20%, 30%, 40%, 50%, 60%, 70%, 80%, or 90%.

Example 38: Comparison of Soluble to Insoluble Protein Mass

This Example describes quantification of the soluble: insoluble ratio of protein mass in fusosomes. In an embodiment, the soluble: insoluble ratio of protein mass in fusosomes will be similar to nucleated cells.

Fusosomes are prepared by any one of the methods described in previous Examples. The fusosome preparation is tested to determine the soluble: insoluble protein ratio using a standard bicinchoninic acid assay (BCA) (e.g. using the commercially available Pierce™ BCA Protein Assay Kit, Thermo Fischer product #23225). Soluble protein samples are prepared by suspending the prepared fusosomes or parental cells at a concentration of 1×10^7 cells or fusosomes/mL in PBS and centrifuging at 1600 g to pellet the fusosomes or cells. The supernatant is collected as the soluble protein fraction.

The fusosomes or cells in the pellet are lysed by vigorous pipetting and vortexing in PBS with 2% TRITON™-X-100. The lysed fraction represents the insoluble protein fraction.

A standard curve is generated using the supplied BSA, from 0 to 20 μg of BSA per well (in triplicate). The fusosome or cell preparation is diluted such that the quantity measured is within the range of the standards. The fusosome preparation is analyzed in triplicate and the mean value is used. The soluble protein concentration is divided by the insoluble protein concentration to yield the soluble: insoluble protein ratio.

In an embodiment, the fusosome soluble: insoluble protein ratio will be within 1%, 2%, 3%, 4%, 5%, 10%, 20%, 30%, 40%, 50%, 60%, 70%, 80%, 90%, or greater compared to the parental cells.

Example 39 Measuring LPS in Fusosomes

This example describes quantification of levels of lipopolysaccharides (LPS) in fusosomes as compared to parental cells. In an embodiment, fusosomes will have lower levels of LPS compared to parental cells.

LPS are a component of bacterial membranes and potent inducer of innate immune responses.

The LPS measurements are based on mass spectrometry as described in the previous Examples.

In an embodiment, less than 5%, 1%, 0.5%, 0.01%, 0.005%, 0.0001%, 0.00001% or less of the lipid content of fusosomes will be LPS.

Example 40: Ratio of Lipids to Proteins in Fusosomes

This Example describes quantification of the ratio of lipid mass to protein mass in fusosomes. In an embodiment, fusosomes will have a ratio of lipid mass to protein mass that is similar to nucleated cells.

Total lipid content is calculated as the sum of the molar content of all lipids identified in the lipidomics data set outlined in a previous Example. Total protein content of the fusosomes is measured via bicinchoninic acid assay as described herein.

Alternatively, the ratio of lipids to proteins can be described as a ratio of a particular lipid species to a specific protein. The particular lipid species is selected from the lipidomics data produced in a previous Example. The specific protein is selected from the proteomics data produced in a previous Example. Different combinations of selected lipid species and proteins are used to define specific lipid: protein ratios.

Example 41: Ratio of Proteins to DNA in Fusosomes

This Example describes quantification of the ratio of protein mass to DNA mass in fusosomes. In an embodiment, fusosomes will have a ratio of protein mass to DNA mass that is much greater than cells.

Total protein content of the fusosomes and cells is measured as described in in a previous Example. The DNA mass of fusosomes and cells is measured as described in a previous Example. The ratio of proteins to total nucleic acids is then determined by dividing the total protein content by the total DNA content to yield a ratio within a given range for a typical fusosome preparation.

Alternatively, the ratio of proteins to nucleic acids is determined by defining nucleic acid levels as the level of a specific house-keeping gene, such as GAPDH, using semi-quantitative real-time PCR (RT-PCR).

The ratio of proteins to GAPDH nucleic acids is then determined by dividing the total protein content by the total GAPDH DNA content to define a specific range of protein: nucleic acid ratio for a typical fusosome preparation.

Example 42: Measuring Fusion with a Target Cell

This example describes quantification of fusosome fusion with a target cell compared to a non-target cell.

In an embodiment, fusosome fusion with a target cell allows the cell-specific delivery of a cargo, carried within the lumen of the fusosome, to the cytosol of the recipient cell. Fusosomes produced by the herein described methods are assayed for fusion rate with a target cell as follows.

In this example, the fusosome comprises a HEK293T cell expressing Myomaker on its plasma membrane. In addition, the fusosome expresses mTagBFP2 fluorescent protein and Cre recombinase. The target cell is a myoblast cell, which expresses both Myomaker and Myomixer, and the non-target cell is a fibroblast cell, which expresses neither Myomaker nor Myomixer. A Myomaker-expressing fusosome is predicted to fuse with the target cell that expresses both Myomaker and Myomixer but not the non-target cell (Quinn et al., 2017, Nature Communications, 8, 15665. doi.org/10.1038/ncomms15665) (Millay et al., 2013, Nature, 499 (7458), 301-305. doi.org/10.1038/nature12343). Both the target and non-target cell types are isolated from mice and stably-express "LoxP-stop-Loxp-tdTomato" cassette under a CMV promoter, which upon recombination by Cre turns on tdTomato expression, indicating fusion.

The target or non-target recipient cells are plated into a black, clear-bottom 96-well plate. Both target and non-target cells are plated for the different fusion groups. Next, 24 hours after plating the recipient cells, the fusosomes expressing Cre recombinase protein and Myomaker are applied to the target or non-target recipient cells in DMEM media. The dose of fusosomes is correlated to the number of recipient cells plated in the well. After applying the fusosomes, the cell plate is centrifuged at 400 g for 5 minutes to help initiate contact between the fusosomes and the recipient cells.

Starting at four hours after fusosome application, the cell wells are imaged to positively identify RFP-positive cells versus GFP-positive cells in the field or well.

In this example, cell plates are imaged using an automated microscope (biotek.com/products/imaging-microscopy-automated-cell-imagers/lionheart-fx-automated-live-cell-imager/). The total cell population in a given well is determined by first staining the cells with Hoechst 33342 in DMEM media for 10 minutes. Hoechst 33342 stains cell nuclei by intercalating into DNA and therefore is used to identify individual cells. After staining, the Hoechst media is replaced with regular DMEM media.

The Hoechst is imaged using the 405 nm LED and DAPI filter cube. GFP is imaged using the 465 nm LED and GFP filter cube, while RFP is imaged using 523 nm LED and RFP filter cube. Images of target and non-target cell wells are acquired by first establishing the LED intensity and integration times on a positive-control well; i.e., recipient cells treated with adenovirus coding for Cre recombinase instead of fusosomes.

Acquisition settings are set so that RFP and GFP intensities are at the maximum pixel intensity values but not saturated. The wells of interest are then imaged using the established settings. Wells are imaged every 4 hours to acquire time-course data for rates of fusion activity.

Analysis of GFP and RFP-positive wells is performed with software provided with the fluorescent microscope or other software (Rasband, W. S., ImageJ, U. S. National Institutes of Health, Bethesda, Maryland, USA, rsb.info.nih.gov/ij/, 1997-2007).

The images are pre-processed using a rolling ball background subtraction algorithm with a 60 μm width. The total cell mask is set on the Hoechst-positive cells. Cells with Hoechst intensity significantly above background intensities are thresholded and areas too small or large to be Hoechst-positive cells are excluded.

Within the total cell mask, GFP and RFP-positive cells are identified by again thresholding for cells significantly above background and extending the Hoechst (nuclei) masks for the entire cell area to include the entire GFP and RFP cellular fluorescence. The number of RFP-positive cells identified in control wells containing target or non-target recipient cells is used to subtract from the number of RFP-positive cells in the wells containing fusosome (to subtract for non-specific Loxp recombination). The number of RFP-positive cells (fused recipient cells) is then divided by the sum of the GFP-positive cells (recipient cells that have not fused) and RFP-positive cells at each time point to quantify the rate of fusosome fusion within the recipient cell population. The rate is normalized to the given dose of fusosome applied to the recipient cells. For rates of targeted fusion (fusosome fusion to targeted cells), the rate of fusion to the non-target cell is subtracted from the rate of fusion to the target cell in order to quantify rates of targeted fusion.

In an embodiment, the average rate of fusion for the fusosomes with the target cells will be in the range of 0.01-4.0 RFP/GFP cells per hour for target cell fusion or at least 1%, 2%, 3%, 4%, 5%, 10%, 20%, 30%, 40%, 50%, 60%, 70%, 80%, 90% or greater than non-target recipient cells with fusosomes. In an embodiment, groups with no fusosome applied will show a background rate of <0.01 RFP/GFP cells per hour.

Example 43: In Vitro Fusion to Deliver a Membrane Protein

This example describes fusosome fusion with a cell in vitro. In an embodiment, fusosome fusion with a cell in vitro results in delivery of an active membrane protein to the recipient cell.

In this example, the fusosomes are generated from a HEK293T cell expressing the Sendai virus HVJ-E protein (Tanaka et al., 2015, Gene Therapy, 22 (October 2014), 1-8. doi.org/10.1038/gt.2014.12). In an embodiment, the fusosomes are generated to express the membrane protein, GLUT4, which is found primarily in muscle and fat tissues and is responsible for the insulin-regulated transport of glucose into cells. Fusosomes with and without GLUT4 are prepared from HEK293T cells as described by any of the methods described in a previous Example.

Muscles cells, such as, C2C12 cells, are then treated with fusosomes expressing GLUT4, fusosomes that do not express GLUT4, PBS (negative control), or insulin (positive control). The activity of GLUT4 on C2C12 cells is measured by the uptake of the fluorescent 2-deoxyglucose analog, 2-[N-(7-nitrobenz-2-oxa-1,3-diaxol-4-yl)amino]-2-deoxy-glucose (2-NBDG). The fluorescence of C2C12 cells is assessed via microscopy using methods described in previous Examples.

In an embodiment, C2C12 cells that are treated with fusosomes that express GLUT4 and insulin are expected to demonstrate increased fluorescence compared to C2C12 cells treated with PBS or fusosomes not expressing GLUT4.

See, also, Yang et al., *Advanced Materials* 29, 1605604, 2017.

Example 44: Measuring Extravasation from Blood Vessels

This Example describes quantification of fusosome extravasation across an endothelial monolayer as tested with an in vitro microfluidic system (J. S Joen et al. 2013, journals.plos.org/plosone/article?id=10.1371/journal.pone.0056910).

Cells extravasate from the vasculature into surrounding tissue. Without wishing to be bound by theory, extravasation is one way for fusosomes to reach extravascular tissues.

The system includes three independently addressable media channels, separated by chambers into which an ECM-mimicking gel can be injected. In brief, the microfluidics system has molded PDMS (poly-dimethyl siloxane; Silgard 184; Dow Chemical, MI) through which access ports are bored and bonded to a cover glass to form microfluidic channels. Channel cross-sectional dimensions are 1 mm (width) by 120 μm (height). To enhance matrix adhesion, the PDMS channels are coated with a PDL (poly-D-lysine hydrobromide; 1 mg/ml; Sigma-Aldrich, St. Louis, MO) solution.

Next, collagen type I (BD Biosciences, San Jose, CA, USA) solution (2.0 mg/ml) with phosphate-buffered saline (PBS; Gibco) and NaOH is injected into the gel regions of the device via four separate filling ports and incubated for 30 min to form a hydrogel. When the gel is polymerized, endothelial cell medium (acquired from suppliers such as Lonza or Sigma) is immediately pipetted into the channels to prevent dehydration of the gel. Upon aspirating the medium, diluted hydrogel (BD science) solution (3.0 mg/ml) is introduced into the cell channel and the excess hydrogel solution is washed away using cold medium.

Endothelial cells are introduced into the middle channel and allowed to settle to form an endothelium. Two days after endothelial cell seeding, fusosomes or macrophage cells (positive control) are introduced into the same channel where endothelial cells had formed a complete monolayer. The fusosomes are introduced so they adhere to and transmigrate across the monolayer into the gel region. Cultures are kept in a humidified incubator at 37° C. and 5% $CO_2$. A GFP-expressing version of the fusosome is used to enable live-cell imaging via fluorescent microscopy. On the following day, cells are fixed and stained for nuclei using DAPI staining in the chamber, and multiple regions of interest are imaged using confocal microscope to determine how many fusosomes passed through the endothelial monolayer.

In an embodiment, DAPI staining will indicate that fusosomes and positive control cells are able to pass through the endothelial barrier after seeding.

Example 45: Measuring Chemotactic Cell Mobility

This Example describes quantification of fusosome chemotaxis. Cells can move towards or away from a chemical gradient via chemotaxis. In an embodiment, chemotaxis will allow fusosomes to home to a site of injury, or track a pathogen. A purified fusosome composition as produced by any one of the methods described in previous Examples is assayed for its chemotactic abilities as follows.

A sufficient number of fusosomes or macrophage cells (positive control) are loaded in a micro-slide well according to the manufacturer's provided protocol in DMEM media (ibidi.com/img/cms/products/labware/channel_slides/S_8032X_Chemotaxis/IN_8032X_Chemot axis.pdf). Fusosomes are left at 37° C. and 5% $CO_2$ for 1 h to attach. Following cell attachment, DMEM (negative control) or DMEM containing MCP1 chemoattractant is loaded into adjacent reservoirs of the central channel and the fusosomes are imaged continuously for 2 hours using a Zeiss inverted widefield microscope. Images are analyzed using ImageJ software (Rasband, W. S., ImageJ, U. S. National Institutes of Health, Bethesda, Maryland, USA, rsb.info.nih.gov/ij/, 1997-2007). Migration co-ordination data for each observed fusosome or cell is acquired with the manual tracking plugin (Fabrice Cordelières, Institut Curie, Orsay, France). Chemotaxis plots and migration velocities is determined with the Chemotaxis and Migration Tool (ibidi). In an embodiment, the average accumulated distance and migration velocity of fusosomes will be within 1%, 2%, 3%, 4%, 5%, 10%, 20%, 30%, 40%, 50%, 60%, 70%, 80%, 90%, 100% or greater than the response of the positive control cells to chemokine. The response of cells to a chemokine is described, e.g., in Howard E. Gendelman et al., Journal of Neuroimmune Pharmacology, 4 (1): 47-59, 2009.

Example 46: Measuring Homing Potential

This Example describes homing of fusosomes to a site of injury. Cells can migrate from a distal site and/or accumulate at a specific site, e.g., home to a site. Typically, the site is a site of injury. In an embodiment, fusosomes will home to, e.g., migrate to or accumulate at, a site of injury.

Eight week old C57BL/6J mice (Jackson Laboratories) are dosed with notexin (NTX) (Accurate Chemical & Scientific Corp), a myotoxin, in sterile saline by intramuscular (IM) injection using a 30G needle into the right tibialis anterior (TA) muscle at a concentration of 2 μg/mL. The skin over the tibialis anterior (TA) muscle is prepared by depilating the area using a chemical hair remover for 45 seconds, followed by 3 rinses with water. This concentration is chosen to ensure maximum degeneration of the myofibers, as well as minimal damage to their satellite cells, the motor axons and the blood vessels.

On day 1 after NTX injection, mice receive an IV injection of fusosomes or cells that express firefly luciferase. Fusosomes are produced from cells that stably express firefly luciferase by any one of the methods described in previous Examples. A bioluminescent imaging system (Perkin Elmer) is used to obtain whole animal images of bioluminescence at 0, 1, 3, 7, 21, and 28 post injection.

Five minutes before imaging, mice receive an intraperitoneal injection of bioluminescent substrate (Perkin Elmer) at a dose of 150 mg/kg in order to visualize luciferase. The imaging system is calibrated to compensate for all device settings. The bioluminescent signal is measured using Radiance Photons, with Total Flux used as a measured value. The region of interest (ROI) is generated by surrounding the signal of the ROI in order to give a value in photons/second. An ROI is assessed on both the TA muscle treated with NTX and on the contralateral TA muscle, and the ratio of photons/second between NTX-treated and NTX-untreated TA muscles is calculated as a measure of homing to the NTX-treated muscle.

In an embodiment, the ratio of photons/second between NTX-treated and NTX-untreated TA muscles in fusosomes and cells will be greater than 1 indicating site specific accumulation of luciferase-expressing fusosomes at the injury.

See, for example, Plant et al., *Muscle Nerve* 34 (5) L 577-85, 2006.

Example 47: Measuring Phagocytic Activity

This Example demonstrates phagocytic activity of fusosomes. In an embodiment, fusosomes have phagocytic activity, e.g., are capable of phagocytosis. Cells engage in phagocytosis, engulfing particles, enabling the sequestration and destruction of foreign invaders, like bacteria or dead cells.

A purified fusosome composition as produced by any one of the methods described in previous Examples comprising a fusosome from a mammalian macrophage having partial or complete nuclear inactivation was capable of phagocytosis assayed via pathogen bioparticles. This estimation was made by using a fluorescent phagocytosis assay according to the following protocol.

Macrophages (positive control) and fusosomes were plated immediately after harvest in separate confocal glass bottom dishes. The macrophages and fusosomes were incubated in DMEM+10% FBS+1% P/S for 1 h to attach.

Fluorescein-labeled *E. coli* K12 and non-fluorescein-labeled *Escherichia coli* K-12 (negative control) were added to the macrophages/fusosomes as indicated in the manufacturer's protocol, and were incubated for 2 h, tools.thermofisher-.com/content/sfs/manuals/mp06694.pdf. After 2 h, free fluorescent particles were quenched by adding Trypan blue. Intracellular fluorescence emitted by engulfed particles was imaged by confocal microscopy at 488 excitation. The number of phagocytotic positive fusosome were quantified using image J software.

The average number of phagocytotic fusosomes was at least 30% 2 h after bioparticle introduction, and was greater than 30% in the positive control macrophages.

Example 48: Measuring Potential for Protein Secretion

This Example describes quantification of secretion by fusosomes. In an embodiment, fusosomes will be capable of secretion, e.g., protein secretion. Cells can dispose or discharge of material via secretion. In an embodiment, fusosomes will chemically interact and communicate in their environment via secretion.

The capacity of fusosomes to secrete a protein at a given rate is determined using the Gaussia luciferase flash assay from ThermoFisher Scientific (catalog #16158). Mouse embryonic fibroblast cells (positive control) or fusosomes as produced by any one of the methods described in previous Examples are incubated in growth media and samples of the media are collected every 15 minutes by first pelleting the fusosomes at 1600 g for 5 min and then collecting the supernatant. The collected samples are pipetted into a clear-bottom 96-well plate. A working solution of assay buffer is then prepared according to the manufacturer's instructions.

Briefly, colenterazine, a luciferin or light-emitting molecule, is mixed with flash assay buffer and the mixture is pipetted into each well of the 96 well plate containing samples. Negative control wells that lack cells or fusosomes include growth media or assay buffer to determine background Gaussia luciferase signal. In addition, a standard curve of purified Gaussia luciferase (Athena Enzyme Systems, catalog #0308) is prepared in order to convert the luminescence signal to molecules of Gaussia luciferase secretion per hour.

The plate is assayed for luminescence, using 500 msec integration. Background Gaussia luciferase signal is subtracted from all samples and then a linear best-fit curve is calculated for the Gaussia luciferase standard curve. If sample readings do not fit within the standard curve, they are diluted appropriately and re-assayed. Using this assay, the capacity for fusosomes to secrete Gaussia luciferase at a rate (molecules/hour) within a given range is determined.

In an embodiment, fusosomes will be capable of secreting proteins at a rate that is 1%, 2%, 3%, 4%, 5%, 10%, 20%, 30%, 40%, 50%, 60%, 70%, 80%, 90%, 100% or greater than the positive control cells.

Example 49: Measuring Signal Transduction Potential

This Example describes quantification of signal transduction in fusosomes. In an embodiment, fusosomes are capable of signal transduction. Cells can send and receive molecular signals from the extracellular environment through signaling cascades, such as phosphorylation, in a process known as signal transduction. A purified fusosome composition as produced by any one of the methods described in previous Examples comprising a fusosome from a mammalian cell having partial or complete nuclear inactivation is capable of signal transduction induced by insulin. Signal transduction induced by insulin is assessed by measuring AKT phosphorylation levels, a key pathway in the insulin receptor signaling cascade, and glucose uptake in response to insulin.

To measure AKT phosphorylation, cells, e.g., Mouse Embryonic Fibroblasts (MEFs) (positive control), and fusosomes are plated in 48-well plates and left for 2 hours in a humidified incubator at 37° C. and 5% $CO_2$. Following cell adherence, insulin (e.g. at 10 nM), or a negative control solution without insulin, is add to the well containing cells or fusosomes for 30 min. After 30 minutes, protein lysate is made from the fusosomes or cells, and phospho-AKT levels are measured by western blotting in insulin stimulated and control unstimulated samples.

Glucose uptake in response to insulin or negative control solution is measured as it is explained in the glucose uptake section by using labeled glucose (2-NBDG). (S. Galic et al., *Molecular Cell Biology* 25 (2): 819-829, 2005).

In an embodiment, fusosomes will enhance AKT phosphorylation and glucose uptake in response to insulin over the negative controls by at least 1%, 2%, 3%, 4%, 5%, 10%, 20%, 30%, 40%, 50%, 60%, 70%, 80%, 90%, 100% or greater.

Example 50: Measuring Ability to Transport Glucose Across Cell Membrane

This Example describes quantification of the levels of a 2-NBDG (2-(N-(7-Nitrobenz-2-oxa-1,3-diazol-4-yl) Amino)-2-Deoxyglucose) a fluorescent glucose analog that can be used to monitor glucose uptake in live cells, and thus measure active transport across the lipid bilayer. In an embodiment, this assay can be used to measure the level of glucose uptake and active transport across the lipid bilayer of the fusosome.

A fusosome composition is produced by any one of the methods described in previous Examples. A sufficient number of fusosomes are then incubated in DMEM with no glucose, 20% Fetal Bovine Serum and 1× Penicillin/Streptomycin for 2 hr at 37° C. and 5% $CO_2$. After a 2 hr glucose starvation period, the medium is changed such that it includes DMEM with no glucose, 20% Fetal Bovine Serum, 1× Penicillin/Streptomycin and 20 μM 2-NBDG (ThermoFisher) and incubated for an additional 2 hr at 37° C. and 5% $CO_2$.

Negative control fusosomes are treated the same, except an equal amount of DMSO is added in place of 2-NBDG.

The fusosomes are then washed thrice with 1×PBS and re-suspended in an appropriate buffer, and transferred to a 96 well imaging plate. 2-NBDG fluorescence is then measured in a fluorimeter using a GFP light cube (469/35 excitation filter and a 525/39 emission filter) to quantify the amount of 2-NBDG that has been transported across the fusosome membrane and accumulated in the fusosome in the 1 hr loading period.

In an embodiment, 2-NBDG fluorescence will be higher in the fusosome with 2-NBDG treatment as compared to the negative (DMSO) control. Fluorescence measure with a 525/39 emission filter will correlate with to the number of 2-NBDG molecules present.

Example 51 Measuring Esterase Activity in the Cytosol

This Example describes quantification of esterase activity, as a surrogate for metabolic activity, in fusosomes. The cytosolic esterase activity in fusosomes is determined by quantitative assessment of calcein-AM staining (Bratosin et al., Cytometry 66 (1): 78-84, 2005).

The membrane-permeable dye, calcein-AM (Molecular Probes, Eugene OR USA), is prepared as a stock solution of 10 mM in dimethylsulfoxide and as a working solution of 100 mM in PBS buffer, pH 7.4. Fusosomes as produced by any one of the methods described in previous Examples or positive control parental Mouse Embryonic Fibroblast cells are suspended in PBS buffer and incubated for 30 minutes with calcein-AM working solution (final concentration in calcein-AM: 5 mM) at 37° C. in the dark and then diluted in PBS buffer for immediate flow cytometric analysis of calcein fluorescence retention.

Fusosomes and control parental Mouse Embryonic Fibroblast cells are experimental permeabilized as a negative control for zero esterase activity with saponin as described in (Jacob et al., *Cytometry* 12 (6): 550-558, 1991). Fusosomes and cells are incubated for 15 min in 1% saponin solution in PBS buffer, pH 7.4, containing 0.05% sodium azide. Due to the reversible nature of plasma membrane permeabilization, saponin is included in all buffers used for further staining and washing steps. After saponin permeabilization, fusosomes and cells are suspended in PBS buffer containing 0.1% saponin and 0.05% sodium azide and incubated (37C in the dark for 45 min) with calcein-AM to a final concentration of 5 mM, washed three times with the same PBS buffer containing 0.1% saponin and 0.05% sodium azide, and analyzed by flow cytometry. Flow cytometric analyses are performed on a FACS cytometer (Becton Dickinson, San Jose, CA, USA) with 488 nm argon laser excitation and emission is collected at 530+/−30 nm. FACS software is used for acquisition and analysis. The light scatter channels are set on linear gains, and the fluorescence channels are set on a logarithmic scale, with a minimum of 10,000 cells analyzed in each condition. Relative esterase activities are calculated based on the intensity of calcein-AM in each sample. All events are captured in the forward and side scatter channels (alternatively, a gate can be applied to select only the fusosome population). The fluorescence intensity (FI) value for the fusosomes is determined by subtracting the FI value of the respective negative control saponin-treated sample. The normalized esterase activity for the fusosomes samples are normalized to the respective positive control cell samples in order to generate quantitative measurements for cytosolic esterase activities.

In an embodiment, a fusosome preparation will have within 1%, 2%, 3%, 4%, 5%, 10%, 20%, 30%, 40%, 50%, 60%, 70%, 80%, 90%, 100% or greater esterase activity compared to the positive control cell.

See also, Bratosin D, Mitrofan L, Palii C, Estaquier J, Montreuil J. Novel fluorescence assay using calcein-AM for the determination of human erythrocyte viability and aging. Cytometry A. 2005 July; 66 (1): 78-84; and Jacob B C, Favre M, Bensa J C. Membrane cell permeabilisation with saponin and multiparametric analysis by flow cytometry. Cytometry 1991; 12:550-558.

Example 52: Measuring Acetylcholinesterase Activity in Fusosomes

Acetylcholinesterase activity is measured using a kit (MAK119, SIGMA) that follows a procedure described previously (Ellman, et al., Biochem. Pharmacol. 7, 88, 1961) and following the manufacturer's recommendations.

Briefly, fusosomes are suspended in 1.25 mM acetylthiocholine in PBS, pH 8, mixed with 0.1 mM 5,5-dithio-bis(2-nitrobenzoic acid) in PBS, pH 7. The incubation is performed at room temperature but the fusosomes and the substrate solution are pre-warmed at 37° C. for 10 min before starting the optical density readings.

Changes in absorption are monitored at 450 nm for 10 min with a plate reader spectrophotometer (ELX808, BIO-TEK instruments, Winooski, VT, USA). Separately, a sample is used for determining the protein content of the fusosomes via bicinchoninic acid assay for normalization. Using this assay, the fusosomes are determined to have <100 AChE activity units/ug of protein.

In an embodiment, AChE activity units/ug of protein values will be less than 0.001, 0.01, 0.1, 1, 10, 100, or 1000.

Example 53: Measuring Metabolic Activity Level

This Example describes quantification of the measurement of citrate synthase activity in fusosomes.

Citrate synthase is an enzyme within the tricarboxylic acid (TCA) cycle that catalyzes the reaction between oxaloacetate (OAA) and acetyl-CoA to generate citrate. Upon hydrolysis of acetyl-CoA, there is a release of CoA with a thiol group (CoA-SH). The thiol group reacts with a chemical reagent, 5,5-Dithiobis-(2-nitrobenzoic acid) (DTNB), to form 5-thio-2-nitrobenzoic acid (TNB), which is a yellow product that can be measured spectrophotometrically at 412 nm (Green 2008). Commercially-available kits, such as the ABCAM™ Human Citrate Synthase Activity Assay Kit (Product #ab119692) provide all the necessary reagents to perform this measurement.

The assay is performed as per the manufacturer's recommendations. Fusosome sample lysates are prepared by collecting the fusosomes as produced by any one of the methods described in previous Examples and solubilizing them in Extraction Buffer (ABCAM™) for 20 minutes on ice. Supernatants are collected after centrifugation and protein content is assessed by bicinchoninic acid assay (BCA, ThermoFisher Scientific) and the preparation remains on ice until the following quantification protocol is initiated.

Briefly, fusosome lysate samples are diluted in 1× Incubation buffer (ABCAM™) in the provided microplate wells, with one set of wells receiving only 1× Incubation buffer. The plate is sealed and incubated for 4 hours at room temperature with shaking at 300 rpm. The buffer is then aspirated from the wells and 1× Wash buffer is added. This washing step is repeated once more. Then, 1× Activity solution is added to each well, and the plate is analyzed on a microplate reader by measuring absorbance at 412 nm every 20 seconds for 30 minutes, with shaking between readings.

Background values (wells with only 1× Incubation buffer) are subtracted from all wells, and the citrate synthase activity is expressed as the change in absorbance per minute per ug of fusosome lysate sample loaded (Δ mOD@412 nm/min/ug protein). Only the linear portion from 100-400 seconds of the kinetic measurement is used to calculate the activity.

In an embodiment, a fusosome preparation will have within 1%, 2%, 3%, 4%, 5%, 10%, 20%, 30%, 40%, 50%, 60%, 70%, 80%, 90%, 100% or greater synthase activity compared to the control cell.

See, for example, Green H J et al. Metabolic, enzymatic, and transporter response in human muscle during three consecutive days of exercise and recovery. Am J Physiol Regul Integr Comp Physiol 295: R1238-R1250, 2008.

Example 54: Measuring Respiration Levels

This Example describes quantification of the measurement of respiration level in fusosomes. Respiration level in cells can be a measure of oxygen consumption, which powers metabolism. Fusosome respiration is measured for oxygen consumption rates by a Seahorse extracellular flux analyzer (Agilent) (Zhang 2012).

Fusosomes as produced by any one of the methods described in previous Examples or cells are seeded in a 96-well Seahorse microplate (Agilent). The microplate is centrifuged briefly to pellet the fusosomes and cells at the bottom of the wells. Oxygen consumption assays are initiated by removing growth medium, replacing with a low-buffered DMEM minimal medium containing 25 mM glucose and 2 mM glutamine (Agilent) and incubating the microplate at 37° C. for 60 minutes to allow for temperature and pH equilibrium.

The microplate is then assayed in an extracellular flux analyzer (Agilent) that measures changes in extracellular oxygen and pH in the media immediately surrounding adherent fusosomes and cells. After obtaining steady state oxygen consumption (basal respiration rate) and extracellular acidification rates, oligomycin (5 μM), which inhibits ATP synthase, and proton ionophore FCCP (carbonyl cyanide 4-(trifluoromethoxy)phenylhydrazone; 2 μM), which uncouples mitochondria, are added to each well in the microplate to obtain values for maximal oxygen consumption rates.

Finally, 5 μM antimycin A (inhibitor of mitochondria complex III) is added to confirm that respiration changes are due mainly to mitochondrial respiration. The minimum rate of oxygen consumption after antimycin A addition is subtracted from all oxygen consumption measurements to remove the non-mitochondrial respiration component. Cell samples that do not appropriately respond to oligomycin (at least a 25% decrease in oxygen consumption rate from basal) or FCCP (at least a 50% increase in oxygen consumption rate after oligomycin) are excluded from the analysis. Fusosomes respiration level is then measured as pmol O2/min/1e4 fusosomes.

This respiration level is then normalized to the respective cell respiration level. In an embodiment, fusosomes will have at least 1%, 2%, 3%, 4%, 5%, 10%, 20%, 30%, 40%, 50%, 60%, 70%, 80%, 90%, 100% or greater respiration level compared to the respective cell samples.

See, for example, Zhang J, Nuebel E, Wisidagama D R R, et al. Measuring energy metabolism in cultured cells, including human pluripotent stem cells and differentiated cells. Nature protocols. 2012; 7 (6): 10.1038/nprot.2012.048. doi: 10.1038/nprot.2012.048.

Example 55: Measuring Phosphatidylserine Levels of Fusosomes

This Example describes quantification of the level of annexin-V binding to the surface of fusosomes.

Dying cells can display phosphatidylserine on the cell surface which is a marker of apoptosis in the programmed cell death pathway. Annexin-V binds to phosphatidylserine, and thus, annexin-V binding is a proxy for viability in cells.

Fusosomes were produced as described herein. For detection of apoptosis signals, fusosomes or positive control cells were stained with 5% annexin V fluor 594 (A13203, Thermo Fisher, Waltham, MA). Each group (detailed in the table below) included an experimental arm that was treated with an apoptosis-inducer, menadione. Menadione was added at 100 μM menadione for 4 h. All samples were run on a flow cytometer (Thermo Fisher, Waltham, MA) and fluorescence intensity was measured with the YL1 laser at a wavelength of 561 nm and an emission filter of 585/16 nm. The presence of extracellular phophatidyl serine was quantified by comparing fluorescence intensity of annexin V in all groups.

The negative control unstained fusosomes were not positive for annexin V staining.

In an embodiment, fusosomes were capable of upregulating phosphatidylserine display on the cell surface in response to menadione, indicating that non-menadione stimulated fusosomes are not undergoing apoptosis. In an embodiment, positive control cells that were stimulated with menadione demonstrated higher-levels of annexin V staining than fusosomes not stimulated with menadione.

TABLE 7

Annexin V staining parameter

| Experimental Arm | Mean Fluorescence Intensity of Annexin V Signal (and standard deviation) |
|---|---|
| Unstained Fusosomes (negative control) | 941 (937) |
| Stained Fusosomes | 11257 (15826) |
| Stained Fusosomes + Menadione | 18733 (17146) |
| Stained Macrophages + Menadione (positive control) | 14301 (18142) |

Example 56: Measuring Juxtacrine-Signaling Levels

This Example describes quantification of juxtacrine-signaling in fusosomes.

Cells can form cell-contact dependent signaling via juxtacrine signaling. In an embodiment, presence of juxtacrine signaling in fusosomes will demonstrate that fusosomes can stimulate, repress, and generally communicate with cells in their immediate vicinity.

Fusosomes produced by any one of the methods described in previous Examples from mammalian bone marrow stromal cells (BMSCs) having partial or complete nuclear inactivation trigger IL-6 secretion via juxtacrine signaling in macrophages. Primary macrophages and BMSCs are co-cultured. Bone marrow-derived macrophages are seeded first into 6-well plates, and incubated for 24 h, then primary mouse BMSC-derived fusosomes or BMSC cells (positive control parental cells) are placed on the macrophages in a DMEM medium with 10% FBS. The supernatant is collected at different time points (2, 4, 6, 24 hours) and analyzed for IL-6 secretion by ELISA assay. (Chang J. et al., 2015).

In an embodiment, the level of juxtacrine signaling induced by BMSC fusosomes is measured by an increase in macrophage-secreted IL-6 levels in the media. In an embodiment, the level of juxtacrine signaling will be at least 1%, 2%, 3%, 4%, 5%, 10%, 20%, 30%, 40%, 50%, 60%, 70%, 80%, 90%, 100% or greater than the levels induced by the positive control bone marrow stromal cells (BMSCs).

Example 57: Measuring Paracrine-Signaling Levels

This Example describes quantification of paracrine signaling in fusosomes.

Cells can communicate with other cells in the local microenvironment via paracrine signaling. In an embodiment, fusosomes will be capable of paracrine signaling, e.g., to communicate with cells in their local environment. In an embodiment, the ability of fusosomes to trigger $Ca^{2+}$ signaling in endothelial cells via paracrine-derived secretion with the following protocol will measure $Ca^{2+}$ signaling via the calcium indicator, fluo-4 AM.

To prepare the experimental plate, murine pulmonary microvascular endothelial cells (MPMVECs) are plated on a 0.2% gelatin coated 25 mm glass bottom confocal dish (80% confluence). MPMVECs are incubated at room temperature for 30 min in ECM containing 2% BSA and 0.003% pluronic acid with 5 μM fluo-4 AM (Invitrogen) final concentration to allow loading of fluo-4 AM. After loading, MPMVECs are washed with experimental imaging solution (ECM containing 0.25% BSA) containing sulfinpyrazone to minimize dye loss. After loading fluo-4, 500 μl of pre-warmed experimental imaging solution is added to the plate, and the plate is imaged by a Zeiss confocal imaging system.

In a separate tube, freshly isolated murine macrophages are either treated with 1 μg/ml LPS in culture media (DMEM+10% FBS) or not treated with LPS (negative control). After stimulation, fusosomes are generated from macrophages by any one of the methods described in previous Examples.

Fusosomes or parental macrophages (positive control) are then labeled with cell tracker red, CMTPX (Invitrogen), in ECM containing 2% BSA and 0.003% pluronic acid. Fusosomes and macrophages are then washed and resuspended in experimental imaging solution. Labeled fusosomes and macrophages are added onto the fluo-4 AM loaded MPMVECs in the confocal plate.

Green and red fluorescence signal is recorded every 3 s for 10-20 min using Zeiss confocal imaging system with argon ion laser source with excitation at 488 and 561 nm for fluo-4 AM and cell tracker red fluorescence respectively. Fluo-4 fluorescence intensity changes are analyzed using imaging software (Mallilankaraman, K. et al., *J Vis Exp.* (58): 3511, 2011). The level of Fluo-4 intensity measured in negative control fusosome and cell groups is subtracted from LPS-stimulated fusosome and cell groups.

In an embodiment, fusosomes, e.g., activated fusosomes, will induce an increase in Fluo-4 fluorescence intensity that is at least 1%, 2%, 3%, 4%, 5%, 10%, 20%, 30%, 40%, 50%, 60%, 70%, 80%, 90%, 100% or greater than the positive control cell groups.

Example 58: Measuring Ability to Polymerize Actin for Mobility

This Example describes quantification of cytoskeletal components, such as actin, in fusosomes. In an embodiment, fusosomes comprise cytoskeletal components such as actin, and are capable of actin polymerization.

Cells use actin, which is a cytoskeletal component, for motility and other cytoplasmic processes. The cytoskeleton is essential to creating motility driven forces and coordinating the process of movement C2C12 cells were enucleated as described herein. Fusosomes obtained from the 12.5% and 15% FICOLL™ layers were pooled and labeled 'Light', while fusosomes from the 16-17% layers were pooled and labeled 'Medium'. Fusosomes or cells (parental C2C12 cells, positive control) were resuspended in DMEM+GLUTAMAX™+10% Fetal Bovine Serum (FBS), plated in 24-well ultra-low attachment plates (#3473, Corning Inc, Corning, NY) and incubated at 37° C.+5% $CO_2$. Samples were taken periodically (5.25 hr, 8.75 hr, 26.5 hr) and stained with 165 μM rhodamine phalloidin (negative control was not stained) and measured on a flow cytometer (#A24858, Thermo Fisher, Waltham, MA) with a FC laser YL1 (561 nm with 585/16 filter) to measure F-actin cytoskeleton content. The fluorescence intensity of rhodamine phalloidin in fusosomes was measured along with unstained fusosomes and stained parental C2C12 cells.

Fusosome fluorescence intensity was greater (FIG. 1) than the negative control at all timepoints, and fusosomes were capable of polymerizing actin at a similar rate to the parental C2C12 cells.

Additional cytoskeletal components, such as those listed in the table below, are measured via a commercially available ELISA systems (Cell Signaling Technology and MyBioSource), according to manufacturer's instructions.

TABLE 8

Cytoskeletal components

| Cytoskeletal protein measured | Commercial Kit Type | Kit ID |
|---|---|---|
| Actin | Path Scan Total B-Actin Sandwich ELISA Kit | Cell Signaling, 7880 |
| Arp2/3 | Human Actin Related protein 2/3 complex subunit(APRC2) ELISA KIT | MyBioSource, MBS7224740 |
| Formin | Formin Binding Protein 1 (FNBP1), ELISA Kit | MyBioSource, MBS9308864 |
| Coronin | Human Coronin 1A ELISA Kit | MyBioSource, MBS073640 |
| Dystrophin | Human dystrophin ELISA Kit | MyBioSource MBS722223 |
| Keratin | Human Keratin 5 ELISA Kit | MyBioSource, MBS081200 |
| Myosin | Human Myosin IG (MYO1G) ELISA Kit | MyBioSource, MBS9312965 |
| Tubulin | Human Tubulin Beta 3 ELISA Kit | MyBioSource, MBS097321 |

Then 100 μL of appropriately-diluted lysate is added to the appropriate well from the microwell strips. The microwells are sealed with tape and incubated for 2 hrs at 37C. After incubation, the sealing tape is removed and the contents are discarded. Each microwell is washed four times with 200 μL of 1× Wash Buffer. After each individual wash, plates are struck onto an absorbent cloth so that the residual wash solution is removed from each well. However, wells are not completely dry at any time during the experiment.

Next, 100 μl of the reconstituted Detection Antibody (green) is added each individual well, except for negative control wells. Then wells are sealed and incubated for 1 hour at 37° C. The washing procedure is repeated after incubation is complete. 100 μL of reconstituted HRP-Linked secondary antibody (red) is added to each of the wells. The wells are sealed with tape and incubated for 30 minutes at 37° C. The sealing tape is then removed and the washing procedure is repeated. 100 μL of TMB Substrate is then added to each well. The wells are sealed with tape, then incubated for 10 minutes at 37° C. Once this final incubation is complete, 100 μL of STOP solution is added to each of the wells and the plate is shaken gently for several seconds.

Spectrophotometric analysis of the assay is conducted within 30 minutes of adding the STOP solution. The under-side of the wells is wiped with lint-free tissue and then absorbance is read at 450 nm. In an embodiment, fusosome samples that have been stained with the detection antibody will absorb more light at 450 nm that negative control fusosome samples, and absorb less light than cell samples that have been stained with the detection antibody.

Example 59: Measuring Average Membrane Potential

This Example describes quantification of the mitochondrial membrane potential of fusosomes. In an embodiment, fusosomes comprising a mitochondrial membrane will maintain mitochondrial membrane potential.

Mitochondrial metabolic activity can be measured by mitochondrial membrane potential. The membrane potential of the fusosome preparation is quantified using a commercially available dye, TMRE, for assessing mitochondrial membrane potential (TMRE: tetramethyl rhodamine, ethyl ester, perchlorate, ABCAM™, Cat #T669).

Fusosomes are generated by any one of the methods described in previous Examples. Fusosomes or parental cells are diluted in growth medium (phenol-red free DMEM with 10% fetal bovine serum) in 6 aliquots (untreated and FCCP-treated triplicates). One aliquot of the samples is incubated with FCCP, an uncoupler that eliminates mitochondrial membrane potential and prevents TMRE staining. For FCCP-treated samples, 2 μM FCCP is added to the samples and incubated for 5 minutes prior to analysis. Fusosomes and parental cells are then stained with 30 nM TMRE. For each sample, an unstained (no TMRE) sample is also prepared in parallel. Samples are incubated at 37° C. for 30 minutes. The samples are then analyzed on a flow cytometer with 488 nm argon laser, and excitation and emission is collected at 530+/−30 nm.

Membrane potential values (in millivolts, mV) are calculated based on the intensity of TMRE. All events are captured in the forward and side scatter channels (alternatively, a gate can be applied to exclude small debris). The fluorescence intensity (FI) value for both the untreated and FCCP-treated samples are normalized by subtracting the geometric mean of the fluorescence intensity of the unstained sample from the geometric mean of the untreated and FCCP-treated sample. The membrane potential state for each preparation is calculated using the normalized fluorescent intensity values with a modified Nernst equation (see below) that can be used to determine mitochondrial membrane potential of the fusosomes or cells based on TMRE fluorescence (as TMRE accumulates in mitochondria in a Nernstian fashion).

Fusosome or cell membrane potential is calculated with the following formula: (mV)=−61.5*log (FIuntreated-normalized/FIFCCP-treated-normalized). In an embodiment, using this assay on fusosome preparations from C2C12 mouse myoblast cells, the membrane potential state of the fusosome preparation will be within about 1%, 2%, 3%, 4%, 5%, 10%, 20%, 30%, 40%, 50%, 60%, 70%, 80%, 90%, 100% or greater than the parental cells. In an embodiment, the range of membrane potential is about −20 to −150 mV.

Example 60: Measuring Persistence Half-Life in a Subject

This Example describes the measurement of fusosome half-life.

Fusosomes are derived from cells that express Gaussia luciferase produced by any one of the methods described in previous Examples, and pure, 1:2, 1:5, and 1:10 dilutions in buffered solution are made. A buffered solution lacking fusosomes is used as a negative control.

Each dose is administered to three eight week old male C57BL/6J mice (Jackson Laboratories) intravenously. Blood is collected from the retro-orbital vein at 1, 2, 3, 4, 5, 6, 12, 24, 48, and 72 hours after intravenous administration of the fusosomes. The animals are sacrificed at the end of the experiment by $CO_2$ inhalation.

Blood is centrifuged for 20 min at room temperature. The serum samples are immediately frozen at −80° C. until bioanalysis. Then, each blood sample is used to carry out a Gaussia luciferase activity assay after mixing the samples with Gaussia luciferase substrate (Nanolight, Pinetop, AZ). Briefly, colenterazine, a luciferin or light-emitting molecule, is mixed with flash assay buffer and the mixture is pipetted into wells containing blood samples in a 96 well plate. Negative control wells that lack blood contain assay buffer to determine background Gaussia luciferase signal.

In addition, a standard curve of positive-control purified *Gaussia* luciferase (Athena Enzyme Systems, catalog #0308) is prepared in order to convert the luminescence signal to molecules of *Gaussia* luciferase secretion per hour. The plate is assayed for luminescence, using 500 msec integration. Background *Gaussia* luciferase signal is subtracted from all samples and then a linear best-fit curve is calculated for the *Gaussia* luciferase standard curve. If sample readings do not fit within the standard curve, they are diluted appropriately and re-assayed. The luciferase signal from samples taken at 1, 2, 3, 4, 5, 6, 12, 24, 48, and 72 hours is interpolated to the standard curve. The elimination rate constant $k_e$ ($h^{-1}$) is calculated using the following equation of a one-compartment model: $C(t)=C_0\times e^{-kext}$, in which C (t) (ng/ml) is the concentration of fusosomes at time t(h) and $C_0$ the concentration of fusosomes at time=0 (ng/ml). The elimination half-life $t_{1/2,e}$(h) is calculated as $\ln(2)/k_e$.

In an embodiment, fusosomes will have a half-life of at least 1%, 2%, 3%, 4%, 5%, 10%, 20%, 30%, 40%, 50%, 60%, 70%, 80%, 90%, 100% or greater than the negative control cells.

Example 61: Delivery of fusosomes via non-endocytic pathway

This example describes quantification of fusosome delivery of Cre to a recipient cell via a non-endocytic pathway.

In an embodiment, fusosomes will deliver agents via a fusosome-mediated, non-endocytic pathway. Without wishing to be bound by theory, delivery of an agent, e.g., Cre, which is carried within the lumen of the fusosomes, directly to the cytosol of the recipient cells without any requirement for endocytosis-mediated uptake of the fusosomes, will occur through a fusosome-mediated, non-endocytic pathway delivery.

In this example, the fusosome comprises a HEK293T cell expressing the Sendai virus H and F protein on its plasma membrane (Tanaka et al., 2015, Gene Therapy, 22 (October 2014), 1-8. doi.org/10.1038/gt.2014.123). In addition, the fusosome expresses mTagBFP2 fluorescent protein and Cre recombinase. The target cell is a RPMI8226 cell which stably-expresses "LoxP-GFP-stop-LoxP-RFP" cassette under a CMV promoter, which upon recombination by Cre switches from GFP to RFP expression, indicating fusion and Cre, as a marker, delivery.

Fusosomes produced by the herein described methods are assayed for delivery of Cre via a non-endocytic pathway as follows. The recipient cells are plated into a black, clear-bottom 96-well plate. Next, 24 hours after plating the recipient cells, the fusosomes expressing Cre recombinase protein and possessing the particular fusogen protein are applied to the recipient cells in DMEM media. To determine the level of Cre delivery via a non-endocytic pathway, a parallel group of recipient cells receiving fusosomes is treated with an inhibitor of endosomal acidification, chloroquine (30 μg/mL). The dose of fusosomes is correlated to the number of recipient cells plated in the well. After applying the fusosomes, the cell plate is centrifuged at 400 g for 5 minutes to help initiate contact between the fusosomes and the recipient cells. The cells are then incubated for 16 hours and agent delivery, Cre, is assessed via imaging.

The cells are imaged to positively identify RFP-positive cells versus GFP-positive cells in the field or well. In this example cell plates are imaged using an automated fluorescence microscope. The total cell population in a given well is determined by first staining the cells with Hoechst 33342 in DMEM media for 10 minutes. Hoechst 33342 stains cell nuclei by intercalating into DNA and therefore is used to identify individual cells. After staining, the Hoechst media is replaced with regular DMEM media.

The Hoechst is imaged using the 405 nm LED and DAPI filter cube. GFP is imaged using the 465 nm LED and GFP filter cube, while RFP is imaged using 523 nm LED and RFP filter cube. Images of the different cell groups are acquired by first establishing the LED intensity and integration times on a positive-control well; i.e., recipient cells treated with adenovirus coding for Cre recombinase instead of fusosomes.

Acquisition settings are set so that RFP and GFP intensities are at the maximum pixel intensity values but not saturated. The wells of interest are then imaged using the established settings.

Analysis of GFP and RFP-positive wells is performed with software provided with the fluorescence microscope or other software (Rasband, W. S., ImageJ, U. S. National Institutes of Health, Bethesda, Maryland, USA, 1997-2007). The images are pre-processed using a rolling ball background subtraction algorithm with a 60 μm width. The total cell mask is set on the Hoechst-positive cells. Cells with Hoechst intensity significantly above background intensities are used to set a threshold, and areas too small or large to be Hoechst-positive cells are excluded.

Within the total cell mask, GFP and RFP-positive cells are identified by again setting a threshold for cells significantly above background and extending the Hoechst (nuclei) masks for the entire cell area to include the entire GFP and RFP cellular fluorescence.

The number of RFP-positive cells identified in control wells containing recipient cells is used to subtract from the number of RFP-positive cells in the wells containing fusosomes (to subtract for non-specific Loxp recombination). The number of RFP-positive cells (recipient cells that received Cre) is then divided by the sum of GFP-positive cells (recipient cells that have not received Cre) and RFP-positive cells to quantify the fraction of fusosome Cre delivered to the recipient cell population. The level is normalized to the given dose of fusosomes applied to the recipient cells. To calculate the value of fusosome Cre delivered via a non-endocytic pathway, the level of fusosome Cre delivery in the presence of chloroquine (FusL+CQ) is determined as well as the level of fusosome Cre delivery in the absence of chloroquine (FusL−CQ). To determine the normalized value of fusosome Cre delivered via a non-endocytic pathway, the following equation is used: [(FusL−CQ)−(FusL+CQ)]/(FusL−CQ).

In an embodiment, the average level of fusosome Cre delivered via a non-endocytic pathway for a given fusosome will be in the range of 0.1-0.95, or at least 1%, 2%, 3%, 4%, 5%, 10%, 20%, 30%, 40%, 50%, 60%, 70%, 80%, 90% or greater than chloroquine treated recipient cells.

Example 62: Delivery of Fusosomes Via Endocytic Pathway

This example describes fusosome delivery of Cre to a recipient cell via an endocytic pathway.

In an embodiment, fusosomes will deliver agents via a fusosome-mediated, endocytic pathway. Without wishing to be bound by theory, delivery of an agent, e.g., a cargo, carried in the lumen of the fusosomes, to the recipient cells with the route of uptake being endocytosis-dependent will occur through a fusosome-mediated, endocytic pathway delivery.

In this example the fusosome comprises microvesicles that were produced by extruding a HEK293T cell expressing a fusogen protein on its plasma membrane through a 2 μm filter (Lin et al., 2016, Biomedical Microdevices, 18 (3). doi.org/10.1007/s10544-016-0066-y) (Riedel, Kondor-Koch, & Garoff, 1984, The EMBO Journal, 3 (7), 1477-83. Retrieved from ncbi.nlm.nih.gov/pubmed/6086326). In addition, the fusosome expresses mTagBFP2 fluorescent protein and Cre recombinase. The target cell is a PC3 cell which stably-expresses "LoxP-GFP-stop-LoxP-RFP" cassette under a CMV promoter, which upon recombination by Cre switches from GFP to RFP expression, indicating fusion and Cre, as a marker, delivery.

Fusosomes produced by the herein described methods are assayed for delivery of Cre via an endocytic pathway as follows. The recipient cells are plated into a cell culture multi-well plate compatible with the imaging system to be used (in this example cells are plated in a black, clear-bottom 96-well plate). Next, 24 hours after plating the recipient cells, the fusosomes expressing Cre recombinase protein and possessing the particular fusogen protein are applied to the recipient cells in DMEM media. To determine the level of Cre delivery via an endocytic pathway, a parallel group of recipient cells receiving fusosomes is treated with an inhibitor of endosomal acidification, chloroquine (30 μg/mL). The dose of fusosomes is correlated to the number of recipient cells plated in the well. After applying the fusosomes, the cell plate is centrifuged at 400 g for 5 minutes to help initiate contact between the fusosomes and the recipient cells. The cells are then incubated for 16 hours and agent delivery, Cre, is assessed via imaging.

The cells are imaged to positively identify RFP-positive cells versus GFP-positive cells in the field or well. In this example cell plates are imaged using an automated fluorescent microscope. The total cell population in a given well is determined by first staining the cells with Hoechst 33342 in DMEM media for 10 minutes. Hoechst 33342 stains cell nuclei by intercalating into DNA and therefore is used to identify individual cells. After staining the Hoechst media is replaced with regular DMEM media.

The Hoechst is imaged using the 405 nm LED and DAPI filter cube. GFP is imaged using the 465 nm LED and GFP filter cube, while RFP is imaged using 523 nm LED and RFP filter cube. Images of the different cell groups are acquired by first establishing the LED intensity and integration times on a positive-control well; i.e., recipient cells treated with adenovirus coding for Cre recombinase instead of fusosomes.

Acquisition settings are set so that RFP and GFP intensities are at the maximum pixel intensity values but not saturated. The wells of interest are then imaged using the established settings.

Analysis of GFP and RFP-positive wells is performed with software provided with the fluorescent microscope or other software (Rasband, W. S., ImageJ, U. S. National Institutes of Health, Bethesda, Maryland, USA, 1997-2007). The images are pre-processed using a rolling ball background subtraction algorithm with a 60 μm width. The total cell mask is set on the Hoechst-positive cells. Cells with Hoechst intensity significantly above background intensities are thresholded and areas too small or large to be Hoechst-positive cells are excluded.

Within the total cell mask, GFP and RFP-positive cells are identified by again thresholding for cells significantly above background and extending the Hoechst (nuclei) masks for the entire cell area to include the entire GFP and RFP cellular fluorescence.

The number of RFP-positive cells identified in control wells containing recipient cells is used to subtract from the number of RFP-positive cells in the wells containing fusosomes (to subtract for non-specific Loxp recombination). The number of RFP-positive cells (recipient cells that received Cre) is then divided by the sum of the GFP-positive cells (recipient cells that have not received Cre) and RFP-positive cells to quantify the fraction of fusosome Cre delivered to the recipient cell population. The level is normalized to the given dose of fusosomes applied to the recipient cells. To calculate the value of fusosome Cre delivered via an endocytic pathway, the level of fusosome Cre delivery in the presence of chloroquine (FusL+CQ) is determined as well as the level of fusosome Cre delivery in the absence of chloroquine (FusL−CQ). To determine the normalized value of fusosome Cre delivered via an endocytic pathway, the following equation is used: (FusL+CQ)/(FusL−CQ).

In an embodiment, the average level of fusosome Cre delivered via an endocytic pathway for a given fusosome will be in the range of 0.01-0.6, or at least 1%, 2%, 3%, 4%, 5%, 10%, 20%, 30%, 40%, 50%, 60%, 70%, 80%, 90% or greater than chloroquine treated recipient cells.

Example 63: Delivery of Fusosomes Via a Dynamin Mediated Pathway, a Macropinocytosis Pathway, or an Actin Mediated Pathway This example describes fusosome delivery of Cre to a recipient cell via a dynamin mediated pathway. A fusosome comprising a microvesicle may be produced as described in the preceding example. Fusosomes are assayed for delivery of Cre via a dynamin-mediated pathway according to the preceding example, except that a group of recipient cells receiving fusosomes is treated with an inhibitor of dynamin, Dynasore (120 μM). To calculate the value of fusosome Cre delivered via a dynamin-mediated pathway, the level of fusosome Cre delivery in the presence of Dynasore (FusL+DS) is determined as well as the level of fusosome Cre delivery in the absence of Dynasore (FusL−DS). The normalized value of fusosome Cre delivered may be calculated as described in the preceding example.

This example also describes delivery of Cre to a recipient cell via macropinocytosis. A fusosome comprising a microvesicle may be produced as described in the preceding example. Fusosomes are assayed for delivery of Cre via macropinocytosis according to the preceding example, except that a group of recipient cells receiving fusosomes is treated with an inhibitor of macropinocytosis, 5-(N-ethyl-N-isopropyl) amiloride (EIPA) (25 μM). To calculate the value of fusosome Cre delivered via macropinocytosis, the level of fusosome Cre delivery in the presence of EIPA (FusL+EPIA) is determined as well as the level of fusosome Cre delivery in the absence of EPIA (FusL−EIPA). The normalized value of fusosome Cre delivered may be calculated as described in the preceding example.

This example also describes fusosome delivery of Cre to a recipient cell via an actin mediated pathway. A fusosome comprising a microvesicle may be produced as described in the preceding example. Fusosomes are assayed for delivery of Cre via macropinocytosis according to the preceding example, except that a group of recipient cells receiving fusosomes is treated with an inhibitor of actin polymerization, Latrunculin B (6 μM). To calculate the value of fusosome Cre delivered via an actin-mediated pathway, the level of fusosome Cre delivery in the presence of Latrunculin B (FusL+LatB) is determined as well as the level of fusosome Cre delivery in the absence of Latrunculin B (FusL−LatB). The normalized value of fusosome Cre delivered may be calculated as described in the preceding example.

Example 64: In Vivo Delivery of Protein

This example describes the delivery of therapeutic agents to the eye by fusosomes.

Fusosomes are derived from hematopoietic stem and progenitor cells using any of the methods described in previous Examples and are loaded with a protein that is deficient in a mouse knock-out.

Fusosomes are injected subretinally into the right eye of a mouse that is deficient for the protein and vehicle control is injected into the left eye of the mice. A subset of the mice is euthanized when they reach 2 months of age.

Histology and H&E staining of the harvested retinal tissue is conducted to count the number of cells rescued in each retina of the mice (described in Sanges et al., The Journal of Clinical Investigation, 126 (8): 3104-3116, 2016).

The level of the injected protein is measured in retinas harvested from mice euthanized at 2 months of age via a western blot with an antibody specific to the PDE6B protein.

In an embodiment, the left eyes of mice, which are administered fusosomes, will have an increased number of nuclei present in the outer nuclear level of the retina compared to the right eyes of mice, which are treated with vehicle. The increased protein is suggestive of complementation of the mutated PBE6B protein.

Example 65: Assessment of Teratoma Formation after Administration of Fusosome This Example describes the absence of teratoma formation with a fusosome. In an embodiment, a fusosome will not result in teratoma formation when administered to a subject.

The fusosomes are produced by any one of the methods described in a previous Example. Fusosomes, tumor cells (positive control) or vehicle (negative control) are subcutaneously injected in PBS into the left flank of mice (12-20 weeks old). Teratoma, e.g., tumor, growth is analyzed 2-3 times a week by determination of tumor volume by caliper measurements for eight weeks after fusosome, tumor cell, or vehicle injection.

In an embodiment, mice administered fusosomes or vehicle will not have a measurable tumor formation, e.g., teratoma, via caliper measurements. In an embodiment, positive control animals treated with tumor cells will demonstrate an appreciable tumor, e.g., teratoma, size as measured by calipers over the eight weeks of observation.

Example 66 Measuring Total RNA in a Fusosome and Source Cell

This Example describes a method to quantify the amount of RNA in a fusosome relative to a source cell. In an embodiment, a fusosome will have similar RNA levels to the source cell. In this assay, RNA levels are determined by measuring total RNA.

Fusosomes are prepared by any one of the methods described in previous Examples. Preparations of the same mass as measured by protein of fusosomes and source cells are used to isolate total RNA (e.g., using a kit such as Qiagen RNEASY™ catalog #74104), followed by determination of RNA concentration using standard spectroscopic methods to assess light absorbance by RNA (e.g. with Thermo Scientific NanoDrop).

In an embodiment, the concentration of RNA in fusosomes will be 5%, 10%, 20%, 30%, 40%, 50%, 60%, 70%, 80%, 90%, 95% of that of source cells per mass of protein.

Example 67: Isolating Fusogenic Microvesicles Freely Released from Cells

This example describes the isolation of fusogenic microvesicles freely released from cells. Fusogenic microvesicles were isolated as follows. $9.2\times10^6$ HEK-293T (ATCC, Cat #CRL-3216) were reverse transfected using Xfect transfection reagent (Takara, Cat #631317) with 10 μg of the pcDNA3.1 expression plasmid containing the open reading frame for VSVg and 15 ug of the pcDNA3.1 expression plasmid containing the open reading frame for bacteriophage P1 Cre Recombinase with a SV40 Nuclear localization sequence in 7.5 mL of complete media (Dulbecco's Modified Eagle Medium (DMEM) supplemented with GLUTAMAX™ (ThermoFisher), 10% fetal calf serum (ThermoFisher), and penicillin/streptomycin antibiotics (ThermoFisher)) in a 100 mm collagen coated dish (Corning).

Twelve hours after seeding, an additional 7.5 mL of complete medium was carefully added. The cells were separated from culture media by centrifugation at 200×g for 10 minutes. Supernatants were collected and centrifuged sequentially twice at 500×g for 10 minutes, once at 2,000×g for 15 minutes, once at 10,000×g for 30 min, and once at 70,000×g for 60 minutes. Freely released fusosomes were pelleted during the final centrifugation step, resuspended in PBS and repelleted at 70,000×g. The final pellet was resuspended in PBS.

See also, Wubbolts R et al. Proteomic and Biochemical Analyses of Human B Cell-derived Exosomes: Potential Implications for their Function and Multivesicular Body Formation. *J. Biol. Chem.* 278:10963-10972 2003.

Example 68: Measuring the Average Size Distribution of Fusosomes

This Example describes measurement of the size distribution of fusosomes.

Fusosomes were prepared as described herein by transient transfection of HEK293T with VSV-G, enucleation and subsequent fractionation with FICOLL™. The fusosomes were measured to determine the size distribution using the method of Example 27, as shown in FIG. 3. It is contemplated that the fusosomes can have less than about 50%, 40%, 30%, 20%, 10%, 5%, or less of the parental cell's variability in size distribution within 90% of the sample. It is contemplated that the fusosomes can have 58% less of the parental cell's variability in size distribution within 90% of the sample.

Example 69: Average Volume of Fusosomes

This example describes measurement of the average volume of fusosomes. Varying the size (e.g., volume) of fusosomes can make them versatile for distinct cargo loading, therapeutic design or application.

Fusosomes were prepared as described herein by transient transfection of HEK293T with VSV-G, enucleation and subsequent fractionation with FICOLL™. The positive control was HEK293T cells.

Analysis with a combination of NTA and confocal microscopy as described in Example 27 was used to determine the size of the fusosomes. The diameter of the fusosomes were measured and the volume calculated, as shown in FIG. 4. It is contemplated that fusosomes can have an average size of greater than 50 nm in diameter. It is contemplated that fusosomes can have an average size of 129 nm in diameter.

Example 70: Comparison of Soluble to Insoluble Protein Mass

This Example describes quantification of the soluble: insoluble ratio of protein mass in fusosomes. The soluble: insoluble ratio of protein mass in fusosomes can, in some instances, be similar to that of nucleated cells.

Fusosomes were prepared as described herein by transient transfection of HEK293T with VSV-G, enucleation and subsequent fractionation with FICOLL™. The fusosome preparation was tested to determine the soluble: insoluble protein ratio using a standard bicinchoninic acid assay (BCA) (Pierce™ BCA Protein Assay Kit, Thermo Fischer product #23225). Soluble protein samples were prepared by suspending the prepared fusosomes or parental cells at a concentration of $1\times10^7$ cells or ~1 mg/mL total fusosomes in PBS and centrifuging at 1,500×g to pellet the cells or 16,000×g to pellet the fusosomes. The supernatant was collected as the soluble protein fraction.

The fusosomes or cells were then resuspended in PBS. This suspension represents the insoluble protein fraction.

Figure 5:
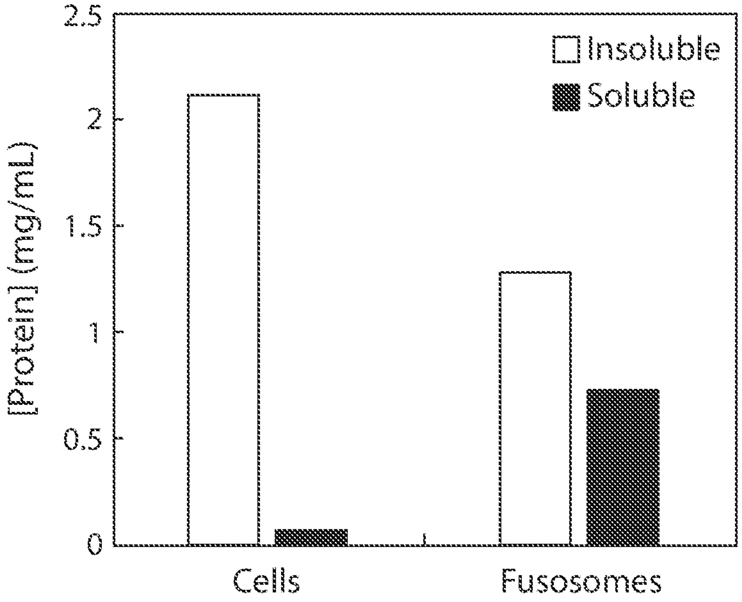
FIG. 5 is a series of diagrams showing the soluble: insoluble ratio observed for fusosomes or a cell preparation.

A standard curve was generated using the supplied BSA, from 0 to 15 μg of BSA per well (in duplicate). The fusosome or cell preparation was diluted such that the quantity measured is within the range of the standards. The fusosome preparation was analyzed in duplicate and the mean value was used. The soluble protein concentration was divided by the insoluble protein concentration to yield the soluble: insoluble protein ratio (FIG. 5).

Example 71: Measuring Fusion with a Target Cell

Fusosomes derived from HEK-293T cells expressing the engineered hemagglutinin glycoprotein of measles virus (MvH) and the fusion protein (F) on the cell surface and containing Cre recombinase protein were generated, as described herein. The MvH was engineered so that its natural receptor binding is ablated and target cell specificity is provided through a single-chain antibody (scFv) that recognizes the cell surface antigen, in this case the scFv is designed to target CD8, a co-receptor for the T cell receptor.

A control fusosome was used which was derived from HEK-293T cells expressing the fusogen VSV-G on its surface and containing Cre recombinase protein. The target cell was a HEK-293T cell engineered to express a "Loxp-GFP-stop-Loxp-RFP" cassette under CMV promoter, as well as engineered to over-express the co-receptors CD8a and CD8b. The non-target cell was the same HEK-293T cell expressing "Loxp-GFP-stop-Loxp-RFP" cassette but without CD8a/b over-expression. The target or non-target recipient cells were plated 30,000 cells/well into a black, clear-bottom 96-well plate and cultured in DMEM media with 10% fetal bovine serum at 37° C. and 5% $CO_2$. Four to six hours after plating the recipient cells, the fusosomes expressing Cre recombinase protein and MvH+F were applied to the target or non-target recipient cells in DMEM media. Recipient cells were treated with 10 μg of fusosomes and incubated for 24 hours at 37° C. and 5% $CO_2$.

Cell plates were imaged using an automated microscope (biotek.com/products/imaging-microscopy-automated-cell-imagers/lionheart-fx-automated-live-cell-imager/). The total cell population in a given well was determined by staining the cells with Hoechst 33342 in DMEM media for 10 minutes. Hoechst 33342 stains cell nuclei by intercalating into DNA and therefore is used to identify individual cells. The Hoechst was imaged using the 405 nm LED and DAPI filter cube. GFP was imaged using the 465 nm LED and GFP filter cube, while RFP was imaged using 523 nm LED and RFP filter cube. Images of target and non-target cell wells were acquired by first establishing the LED intensity and integration times on a positive-control well; i.e., recipient cells treated with adenovirus coding for Cre recombinase instead of fusosomes.

Acquisition settings were set so that Hoescht, RFP, and GFP intensities are at the maximum pixel intensity values but not saturated. The wells of interest were then imaged using the established settings. Focus was set on each well by autofocusing on the Hoescht channel and then using the established focal plane for the GFP and RFP channels. Analysis of GFP and RFP-positive cells was performed with Gen5 software provided with automated fluorescent microscope (www.biotek.com/products/software-robotics-software/gen5-microplate-reader-and-imager-software/).

The images were pre-processed using a rolling ball background subtraction algorithm with a 60 μm width. Cells with GFP intensity significantly above background intensities were thresholded and areas too small or large to be GFP-positive cells were excluded. The same analysis steps were applied to the RFP channel. The number of RFP-positive cells (recipient cells receiving Cre) was then divided by the sum of the GFP-positive cells (recipient cells that did not show delivery) and RFP-positive cells to quantify the percent RFP conversion, which describes the amount of fusosome fusion within the target and non-target recipient cell population. For amounts of targeted fusion (fusosome fusion to targeted recipient cells), the percent RFP conversion value is normalized to the percentage of recipient cells that are target recipient cells (i.e., expressing CD8), which was assessed by staining with anti-CD8 antibody conjugated to phycoerythrin (PE) and analyzed by flow cytometry. Finally, the absolute amount of targeted fusion was determined by subtracting the amount of non-target cell fusion from the target cell fusion amount (any value <0 was considered to be 0).

Figure 6:
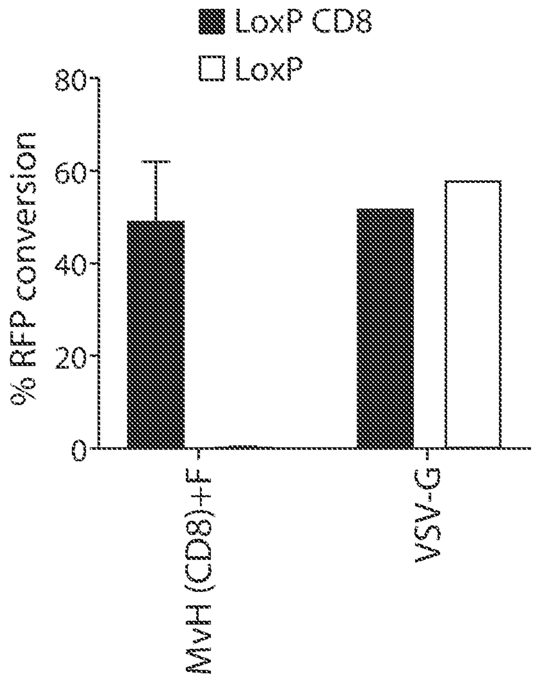
FIG. 6 is a series of diagrams showing MvH(CD8)+F fusosome fusion to target or non-target cells and absolute amount of targeted fusion.

With this assay, the fusosome derived from a HEK-293T cell expressing the engineered MvH(CD8)+F on its surface and containing Cre recombinase protein showed a percentage RFP conversion of 25.2+/−6.4% when the recipient cell was the target HEK-293T cell expressing the "Loxp-GFP-stop-Loxp-RFP" cassette, and 51.1% of these recipient cells were observed to be CD8-positive. From these results, the normalized percentage RFP conversion or amount of targeted fusion was determined to be 49.3+/−12.7% for targeted fusion. The same fusosome showed a percentage RFP conversion of 0.5+/−0.1% when the recipient was the non-target HEK-293T cell expressing "Loxp-GFP-stop-Loxp-RFP" but with no expression of CD8. Based on the above, the absolute amount of targeted fusion for the MvH(CD8)+F fusosome determined to be 48.8% and the absolute amount of targeted fusion for the control VSV-G fusosome was determined to be 0% (FIG. 6).

Example 72: Measuring Ability to Transport Glucose Across Cell Membrane

Fusosomes from HEK-293T cells expressing the envelope glycoprotein G from vesicular stomatitis virus (VSV-G) on the cell surface and expressing Cre recombinase protein were generated according by the standard procedure of ultracentrifugation through a FICOLL™ gradient to obtain small particle fusosomes as described herein. To measure the ability of the fusosomes to transport glucose across the cell membrane, the levels of a 2-NBDG (2-(N-(7-Nitrobenz-2-oxa-1,3-diazol-4-yl)Amino)-2-Deoxyglucose) fluorescent glucose analog, that can be used to monitor glucose uptake in live cells, was quantified to assess active transport across the lipid bilayer. A commercially-available kit from Biovision Inc. (Cat #K682) was used for the assay according to manufacturer's instructions.

Briefly, the fusosome sample was measured for total protein content by bicinchoninic acid assay (BCA, ThermoFisher, Cat #23225) according to manufacturer's instructions. Next 40 ug of fusosome total protein was pelleted by centrifugation at 3000 g for 5 minutes in a table-top centrifuge, followed by resuspension in 400 μL of DMEM supplemented with 0.5% fetal bovine serum. This was done in duplicate for each sample, and one of the duplicates was treated with 4 μL of phloretin (provided with the kit), a natural phenol that inhibits glucose uptake, as a control for glucose uptake inhibition. The samples were then incubated for 1 hour at room temperature. After the incubation, the fusosome sample was pelleted and resuspended in 400 μL of glucose uptake mix prepared previously (see Table 9 below for formulation). Samples pre-treated with phloretin were resuspended in glucose uptake mix with phloretin; samples not pre-treated were resuspended in glucose uptake mix with 20 μL of PBS instead of phloretin. Also a parallel set of fusosome samples were resuspended in DMEM media with 0.5% FBS only as a negative control for flow cytometry analysis.

TABLE 9

Glucose uptake mix formulation

| Reagent | Volume (uL) |
|---|---|
| DMEM media with 0.5% FBS | 1880 |
| 2-NBDG reagent | 20 |
| Glucose Uptake Enhancer | 100 |
| Optional: Phloretin | 20 |

The samples were then incubated at 37° C. with 5% $CO_2$ for 30 minutes. After the incubation cells were pelleted, washed once with 1 mL of 1× Analysis Buffer (provided with kit), pelleted again, and resuspended in 400 μL of 1× Analysis Buffer.

The samples were then measured for 2-NBDG uptake by flow cytometry analysis using an Invitrogen ATTUNE™ NxT acoustic focusing cytometer. 2-NBDG was excited with a 488 nm laser and emission captured at 513±26 nm. Forward and side scatter gating was initially used to capture fusosome-sized events and discard small debris. Events positive for 2-NBDG were determined by gating at the minimum level for which the 2-NBDG negative control sample showed <0.5% of events positive for 2-NBDG staining. The gated cells positive for 2-NBDG fluorescence were then assessed for the mean fluorescence intensity (F.I.) of 2-NBDG in order to calculate a value for glucose uptake for the fusosomes with and without phloretin treatment.

Figure 7:
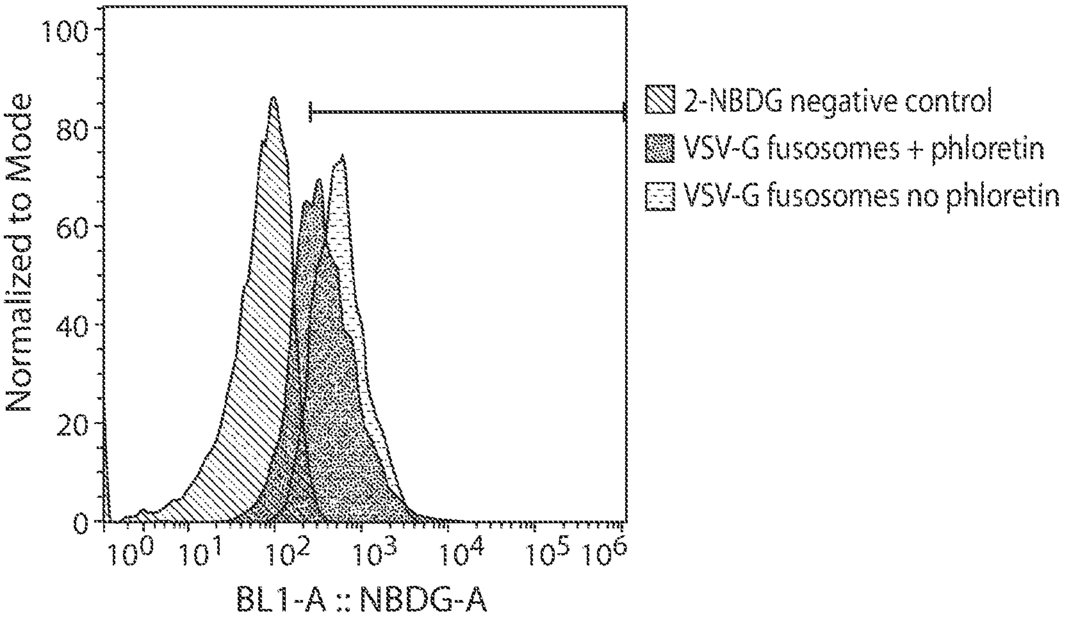
FIG. 7 is a diagram showing 2-NBDG mean fluorescence intensity in VSV-G fusosomes.

With this assay, the fusosome derived from a HEK-293T cell expressing the VSV-G and Cre showed a 2-NBDG mean F.I. of 631.0+/−1.4 without phloretin treatment and a mean F.I. of 565.5+/−4.9 with phloretin treatment (FIG. 7).

Example 73: Measuring Esterase Activity in the Cytosol

Fusosomes from C2C12 cells were generated according to the standard procedure of ultracentrifugation through a FICOLL™ gradient to obtain small particle fusosomes as described herein. To measure the esterase activity in the cytosol of the fusosomes, samples were stained with Calcein AM (BD Pharmigen, Cat #564061), a fluorescein derivative and nonfluorescent vital dye that passively crosses the cell membrane of viable cells and is converted by cytosolic esterases into green fluorescent calcein, which is retained by cells with intact membranes and inactive multidrug resistance protein.

Briefly, the fusosome sample was measured for total protein content by bicinchoninic acid assay (BCA, ThermoFisher, Cat #23225) according to manufacturer's instructions. Next 20 ug of fusosome total protein was pelleted by centrifugation at 3000 g for 5 minutes in a table-top centrifuge, followed by resuspension in 400 μL of DMEM supplemented with 0.5% fetal bovine serum. The membrane-permeable dye, calcein-AM was prepared as a stock solution of 10 mM in dimethylsulfoxide and as a working solution of 1 mM in PBS buffer, pH 7.4. VSV-G fusosomes were stained with 1 μM solution of calcein-AM diluted in DMEM media. Samples were incubated at 37° C. in the dark for 30 minutes and then pelleted by centrifugation. After washing twice with PBS buffer, fusosomes were resuspended in PBS and analyzed by flow cytometry.

The samples were measured for calcein fluorescence retention using an Invitrogen ATTUNE™ NXT acoustic focusing cytometer. Calcein AM was excited with a 488 nm laser and emission captured at 513±26 nm. Forward and side scatter gating was initially used to capture fusosome-sized events and discard small debris. Events positive for calcein were determined by gating at the minimum level for which the calcein negative control sample showed <0.5% of events positive for calcein staining. The gated cells positive for calcein fluorescence were then assessed for the mean fluorescence intensity (F.I.) of calcein in order to calculate a value for esterase activity in the cytosol of fusosomes.

Figure 8:
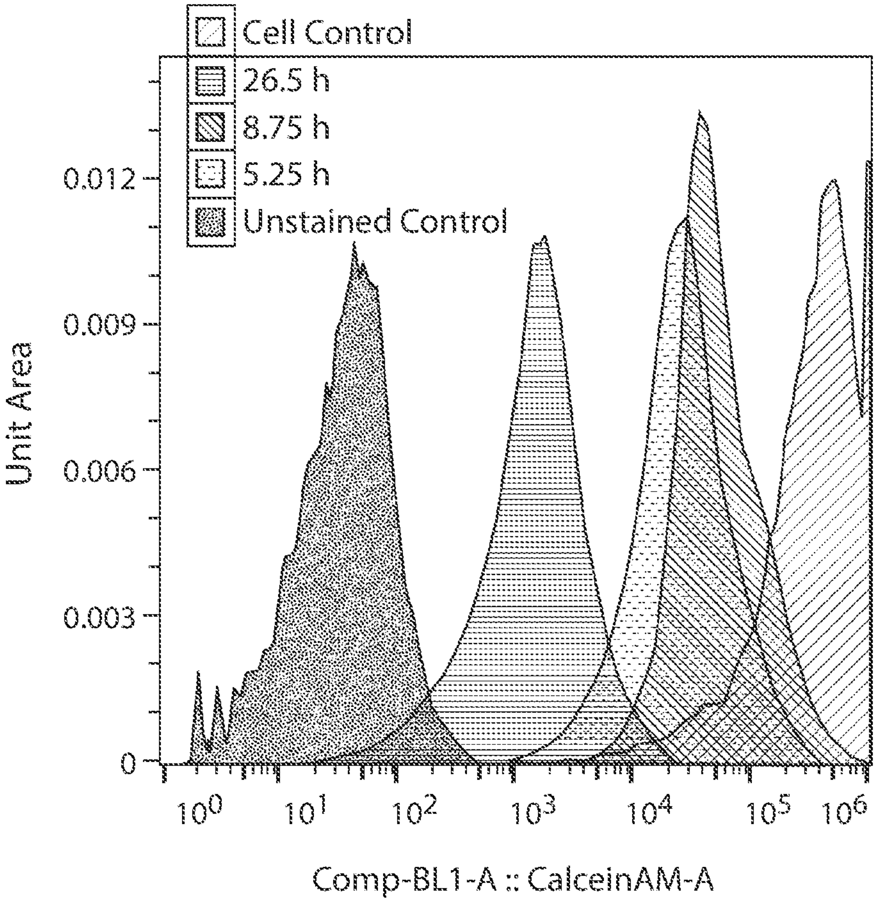
FIG. 8 is a diagram showing esterase activity in the cytosol of VSV-G fusosomes.

With this assay the fusosome derived from a C2C12 cell showed an esterase activity (mean calcein F.I.) of 631.0+/−1.4 (FIG. 8).

Example 74: Measuring Acetylcholinesterase Activity in Fusosomes

Fusosomes from HEK-293T cells expressing the placental cell-cell fusion protein syncytin-1 (Syn1) on the cell surface and expressing Cre recombinase protein were generated as described herein. Acetylcholinesterase activity was measured using the FluoroCet Quantitation Kit (System Biosciences, Cat #FCET96A-1) following the manufacturer's recommendations.

Briefly, fusosomes were pelleted via ultracentrifugation at 120,000 g for 90 minutes and resuspended carefully in phosphate-buffered saline (PBS). Next fusosomes were quantified for total protein content by bicinchoninic acid assay (BCA, ThermoFisher, Cat #23225) according to manufacturer's instructions. After BCA quantification of protein concentration, 1000 ng of total fusosome protein was diluted with PBS to a volume of 60 μL, followed by addition of 60 μL of Lysis Buffer to lyse the particles. After a 30 minute incubation on ice the samples were ready to run in the FluoroCet assay.

In duplicate wells of a 96-well plate, 50 μL of lysed fusosome sample was mixed with 50 μL of Working stock of Buffer A and 50 μL of Working stock of Buffer B. In parallel, a standard curve was prepared by pipetting 2 μL of the provided standard in 126 μL of 1× Reaction buffer. This standard solution was then serial diluted 5× to make a six-point standard curve consisting of 2.0E+08, 1.0E+08, 5.0E+07, 2.5E+07, 1.25E+07, and 6.25E+06 exosome equivalents of acetylcholinesterase activity. 50 μL of each standard was then mixed with 50 μL of Working stock of Buffer A and 50 μL of Working stock of Buffer B in duplicate wells of the 96-well plate. 50 μL of 1× Reaction buffer was used as a blank. The plate was mixed by tapping the sides followed by incubation in the dark for 20 minutes at room temperature. The plate was then measured immediately using a fluorescence plate reader set at Excitation: 530-570 nm and Emission: 590-600 nm. The plate was shaken for 30 sec before reading.

The relative fluorescence units (RFU) were then plotted against the known exosome equivalents of acetylcholinesterase activity after subtracting the RFU values from the blank wells. A linear regression line was then calculated and the equation used to determine the acetylcholinesterase activity (in exosome equivalents) for the fusosome samples from the measured RFU values. The measured acetylcholinesterase activity for Syn1 fusosomes are shown in Table 10:

TABLE 10

Acetylcholinesterase activity in fusosomes and control particles

| Sample | Acetylcholinesterase activity (exosome equivalents) |
|---|---|
| Syn1 fusosomes | 6.83E+05 +/− 2.21E+05 |

Example 75: Measuring Metabolic Activity Level

Fusosomes from HEK-293T cells expressing the envelope glycoprotein G from vesicular stomatitis virus (VSV-G) on the cell surface and expressing Cre recombinase protein were generated as described herein. To determine the metabolic activity level of the fusosome preparation, citrate synthase activity was assessed using a commercially available kit from Sigma (Cat #CS0720) which provides all of the necessary reagents. Citrate synthase is an enzyme within the tricarboxylic acid (TCA) cycle that catalyzes the reaction between oxaloacetate (OAA) and acetyl-CoA to generate citrate. Upon hydrolysis of acetyl-CoA, there is a release of CoA with a thiol group (CoA-SH). The thiol group reacts with a chemical reagent, 5,5-Dithiobis-(2-nitrobenzoic acid) (DTNB), to form 5-thio-2-nitrobenzoic acid (TNB), which has a yellow product that can be measured spectrophotometrically at 412 nm.

The assay was performed as per the manufacturer's recommendations. Briefly, fusosome sample was measured for total protein content by bicinchoninic acid assay (BCA, ThermoFisher, Cat #23225) according to manufacturer's instructions. Next 400 ug of fusosome total protein was pelleted by centrifugation at 3000 g for 5 minutes in a table-top centrifuge. The fusosomes were washed once by pelleting again and resuspending in ice-cold PBS. Fusosomes were pelleted again and supernatant was removed. The pellet was lysed in 100 μL of CellLytic M buffer with 1× protease inhibitors. After mixing by pipetting, the lysed sample was incubated for 15 minutes at room temperature to complete lysis. The sample was then centrifuged at 12,000 g for 10 minutes and the supernatant was transferred to a new microcentrifuge tube and stored at −80° C. until the subsequent assay was performed.

To initiate the citrate synthase activity assay, all assay solutions were warmed to room temperature prior to using. The lysed fusosome sample was mixed with assay solutions according to Table 11 below:

TABLE 11

Reaction Scheme for Citrate Synthase Activity Measurement in 96 Well Plate

| Sample | Assay buffer | 30 mM Acetyl CoA solution | 10 mM DTNB solution | 10 mM OAA solution (added last) |
|---|---|---|---|---|
| 4 uL | 182 uL | 2 uL | 2 uL | 10 uL |

The volumes in Table 11 represent volumes for a single well of a 96-well plate. Samples were measured in duplicates. All components of the reaction were mixed and pipetted into a single well of a 96-well plate. The absorbance at 412 nm was then analyzed on a microplate reader for 1.5 minutes to measure the baseline reaction. Next, 10 μL of the 10 mM OAA solution was added to each well to initiate the reaction. The plate was shaken for 10 seconds in the microplate reader before reading the absorbance at 412 nm for 1.5 minutes with a measurement every 10 seconds.

To calculate the citrate synthase activity, the absorbance at 412 nm was plotted against time for each reaction. The change in absorbance per minute was calculated for the linear range of the plot for before (endogenous activity) and after (total activity) OAA addition. The net citrate synthase activity was then calculated by subtracting the endogenous activity from the total activity for the sample. This value was then used to calculate the citrate synthase activity based on the equation and constant values provided by the manufacturer. The measured citrate synthase activity for the VSV-G fusosomes was 1.57E-02+/−1.86E-03 μmol/ug fusosome/min.

Example 76: Measuring Respiration Levels

Fusosomes from HEK-293T cells expressing the envelope glycoprotein G from vesicular stomatitis virus (VSV-G) on the cell surface were generated according by the standard procedure of ultracentrifugation through a FICOLL™ gradient to obtain small particle fusosomes as described herein. Respiration level in the fusosome preparation were determined by measuring mitochondrial oxygen consumption rates by a Seahorse extracellular flux analyzer (Agilent).

Briefly, the fusosome sample was measured for total protein content by bicinchoninic acid assay (BCA, ThermoFisher, Cat #23225) according to manufacturer's instructions. Next 20 μg of fusosome total protein was pelleted by centrifugation at 3000 g for 5 minutes in a table-top centrifuge, followed by resuspension (in quadruplicates) in 150 μL of XF Assay media (Agilent Cat #103575-100) supplemented with 25 mM glucose and 2 mM glutamine (pH 7.4). The resuspended samples were then added to one well of a 96-well Seahorse plate (Agilent).

Oxygen consumption assays were initiated by incubating the 96-well Seahorse plate with samples at 37° C. for 60 minutes to allow temperature and pH to reach equilibrium. The microplate was then assayed in the XF96 Extracellular Flux Analyzer (Agilent) to measure extracellular flux changes of oxygen and pH in the media immediately surrounding the fusosomes. After obtaining steady state oxygen consumption and extracellular acidification rates, oligomycin (5 μM), which inhibits ATP synthase, and proton ionophore FCCP (carbonyl cyanide 4-(trifluoromethoxy)phenylhydrazone; 2 μM), which uncouples mitochondria, were injected sequentially through reagent delivery chambers for each well in the microplate to obtain values for maximal oxygen consumption rates. Finally, 5 μM antimycin A (inhibitor of mitochondrial complex III) was injected to confirm that respiration changes were due mainly to mitochondrial respiration. The rates of antimycin A respiration were subtracted from the other three respiration rates in order to determine the basal, uncoupled (oligomycin-resistant), and maximal (FCCP-induced) mitochondrial respiration rates.

Using this assay it was determined that donor VSV-G fusosomes showed basal, uncoupled, and maximal oxygen consumption (respiration) rates according to Table 12 below.

TABLE 12

Respiration rates of VSV-G fusosomes

| Respiration state | Mitochondrial oxygen consumption (respiration) rate (pmol/min/20 μg fusosome) AVG ± SEM |
|---|---|
| Basal | 11.3 ± 3.0 |
| Uncoupled | 10.1 ± 2.3 |
| Maximal | 20.0 ± 1.9 |

Example 77: Measuring Phosphatidylserine Levels of Fusosomes

Fusosomes from HEK-293T cells expressing the envelope glycoprotein G from vesicular stomatitis virus (VSV-G) on the cell surface and expressing Cre recombinase protein were generated according by the standard procedure of ultracentrifugation through a FICOLL™ gradient to obtain small particle fusosomes as described herein. To measure the phosphatidylserine levels of the fusosomes, annexin V staining was performed using a commercially available annexin V conjugated with ALEXA FLUOR™ 647 dye (Cat #A23204) according to the manufacturer's instructions.

Annexin V is a cellular protein that can bind phosphatidylserine when it is exposed on the outer leaflet of the plasma membrane; thus, the readout of annexin V binding to a sample can provide an assessment of phosphatidylserine levels in the sample.

Briefly, the fusosome sample was measured for total protein content by bicinchoninic acid assay (BCA, ThermoFisher, Cat #23225) according to manufacturer's instructions. Next 40 μg of fusosome total protein was pelleted by centrifugation (in sample triplicates) at 3000 g for 5 minutes in a table-top centrifuge, followed by resuspension in 400 μL of DMEM supplemented with 2% fetal bovine serum. One sample was treated with 40 μM antimycin A. The samples were then incubated for 1 hour at 37C. After the incubation samples were then pelleted by centrifugation again and resuspended in 100 μL annexin-binding buffer (ABB; 10 mM HEPES, 140 mM NaCl, 2.5 mM $CaCl_2$), pH 7.4). Next 5 μL of annexin V conjugated with ALEXA FLUOR™ 647 was added to each sample (except for the negative control with no annexin V staining). The samples were incubated for 15 minutes at room temperature followed by addition of 400 μL ABB.

The samples were then measured for annexin V staining by flow cytometry analysis using an Invitrogen ATTUNE™ NxT acoustic focusing cytometer. Annexin V conjugated with ALEXA FLUOR™ 647 was excited with a 638 nm laser and emission captured at 670±14 nm. Forward and side scatter gating was initially used to capture fusosome-sized events and discard small debris. Events positive for ALEXA FLUOR™ 647 (annexin V) staining were determined by gating at the minimum level for which the unstained, annexin V-negative control sample showed <0.5% of events positive for ALEXA FLUOR™ 647 staining. The gated events positive for ALEXA FLUOR™ 647 staining were then assessed for the percentage of annexin V-positive events of the total parent population (fusosome-sized events in the forward/side scatter gate) and this value was used as the quantification of phosphatidylserine levels in the fusosome sample.

With this assay the fusosome derived from a HEK-293T cell expressing the VSV-G and Cre showed a % annexin V-positive fusosomes of 63.3±2.3% without antimycin A treatment and percentage of annexin V-positive fusosomes of 67.6±5.7% with antimycin A treatment.

Example 78: Measuring Average Mitochondrial Membrane Potential

Fusosomes from HEK-293T cells expressing the envelope glycoprotein G from vesicular stomatitis virus (VSV-G) on the cell surface and expressing Cre recombinase protein were generated according by the standard procedure of ultracentrifugation through a FICOLL™ gradient to obtain small particle fusosomes as described herein. To measure the average mitochondrial membrane potential levels of the fusosomes, a commercially available dye that is mitochondrial membrane potential sensitive, tetramethyl rhodamine, ethyl ester, perchlorate (TMRE; ABCAM™, Cat #T669) was used for assessing mitochondrial membrane potential. To normalize TMRE fluorescence intensity (FI) to the amount of mitochondria in the sample, MitoTracker Green FM dye (MTG; ThermoFisher, Cat #M7514) was used to co-stain samples in order to normalize TMRE FI to the MTG FI and thus to the amount of mitochondria in the sample. In addition, carbonyl cyanide-p-trifluoromethoxyphenylhydrazone (FCCP; Sigma Cat #C2920) was used to treat a parallel set of samples in order to fully depolarize the mitochondrial membrane potential and thus allow quantification of mitochondrial membrane potential in millivolts based on the decrease in TMRE FI.

Briefly, the fusosome sample was measured for total protein content by bicinchoninic acid assay (BCA, ThermoFisher, Cat #23225) according to manufacturer's instructions. Next 40 μg of fusosome total protein was pelleted by centrifugation (in sample quadruplicates for untreated and FCCP-treated duplicates) at 3000 g for 5 minutes in a table-top centrifuge, followed by resuspension in 100 μL of DMEM supplemented with 2% fetal bovine serum and containing TMRE and MTG dyes at a final concentration of 30 nM and 200 nM, respectively. A parallel set of fusosome samples was left unstained as a negative control. The samples were incubated at for 45 minutes at 37° C. After incubation, samples were pelleted by centrifugation and resuspended in 400 μL of phenol red-free DMEM media containing 30 nm TMRE. One set of duplicates was treated with 20 μM FCCP for 5 minutes before assessment by flow cytometry.

The samples were then measured for annexin V staining by flow cytometry analysis using an Invitrogen ATTUNE™ NxT acoustic focusing cytometer. MTG was excited with a 488 nm laser and emission captured at 530±30 nm. TMRE was excited with a 561 nm laser and emission captured at 585±16 nm. Forward and side scatter gating was initially used to capture fusosome-sized events and discard small debris. Events positive for MTG and TMRE staining were determined by gating at the minimum level for which the unstained control sample showed <0.5% of events positive for MTG or TMRE staining. The gated events positive for MTG and TMRE staining were then assessed for the mean FI of MTG and TMRE.

Membrane potential values (in millivolts, mV) are calculated based on the intensity of TMRE after normalizing TMRE FI values to MTG FI values. This TMRE/MTG ratio value allows for normalization TMRE intensity to the amount of mitochondria in the sample. The TMRE/MTG ratio value for both the untreated and FCCP-treated samples are calculated and used to determine the membrane potential in millivolts using a modified Nernst equation (see below) that can determine mitochondrial membrane potential based on TMRE fluorescence (as TMRE accumulates in mitochondria in a Nernstian fashion). Fusosome membrane potential is calculated with the following formula: (mV)=−61.5*log (FI(untreated)/FI(FCCP-treated)). Using this equation, the calculated mitochondrial membrane potential of the VSV-G fusosome sample was-29.6±1.5 millivolts.

Example 79: Measuring Targeting Potential in a Subject (BiVs-Cre Gesicles)

This example assesses the ability of a fusosome to target a specific body site. Fusosomes were derived using methods as described herein and were loaded with cre-recombinase protein.

Two doses of fusosomes (1× and 3×) were delivered into Loxp Luciferase (Jackson Laboratory, 005125) mice were injected intravenously (I.V.) via tail vein. Mice were placed underneath a heat lamp (utilizing a 250 W (infrared) heat lamp bulb) for ~5 minutes (or until mice begin to groom their whiskers excessively) to dilate the tail vein. Mice were placed on a restrainer and tail was wiped down with 70% ethanol to better visualize the vein.

Using a tuberculin syringe, 200 μL of fusosome 1× solution (8.5e8±1.4e8 particles/μL, mean(SEM)) or 3× solution (2.55e9±1.4e8 particles/μL, mean (SEM)) was injected IV. Upon completion of injection, the syringe was removed, and pressure was applied to the injection site.

After fusion, CRE protein translocated to the nucleus to carry out recombination, which resulted in the constitutive expression of luciferase. Three days post-treatment, the ventral region of subjects was prepared by depilating the area (Nair Hair Remover cream for 45 seconds, followed by cleaning the area with 70% ethanol). Subjects were then treated with D-luciferin (Perkin Elmer, 150 mg/kg) via intraperitoneal administration. This enabled the detection of luciferase expression via in vivo bioluminescent imaging. The animal was placed into an in vivo bioluminescent imaging chamber (Perkin Elmer) which houses a cone anesthetizer (isoflurane) to prevent animal motion. Photon collection was carried out between 3-15 minutes post-injection to observe the maximum bioluminescent signal due to D-luciferin pharmacokinetic clearance. Maximum radiance was recorded in photons/see/cm2/radians. Total flux, which integrates the radiance over the area, was quantified using a region of interest (ROI) tool within the Living Image Software (Perkin Elmer) and reported in photons/sec.

Figure 9A:
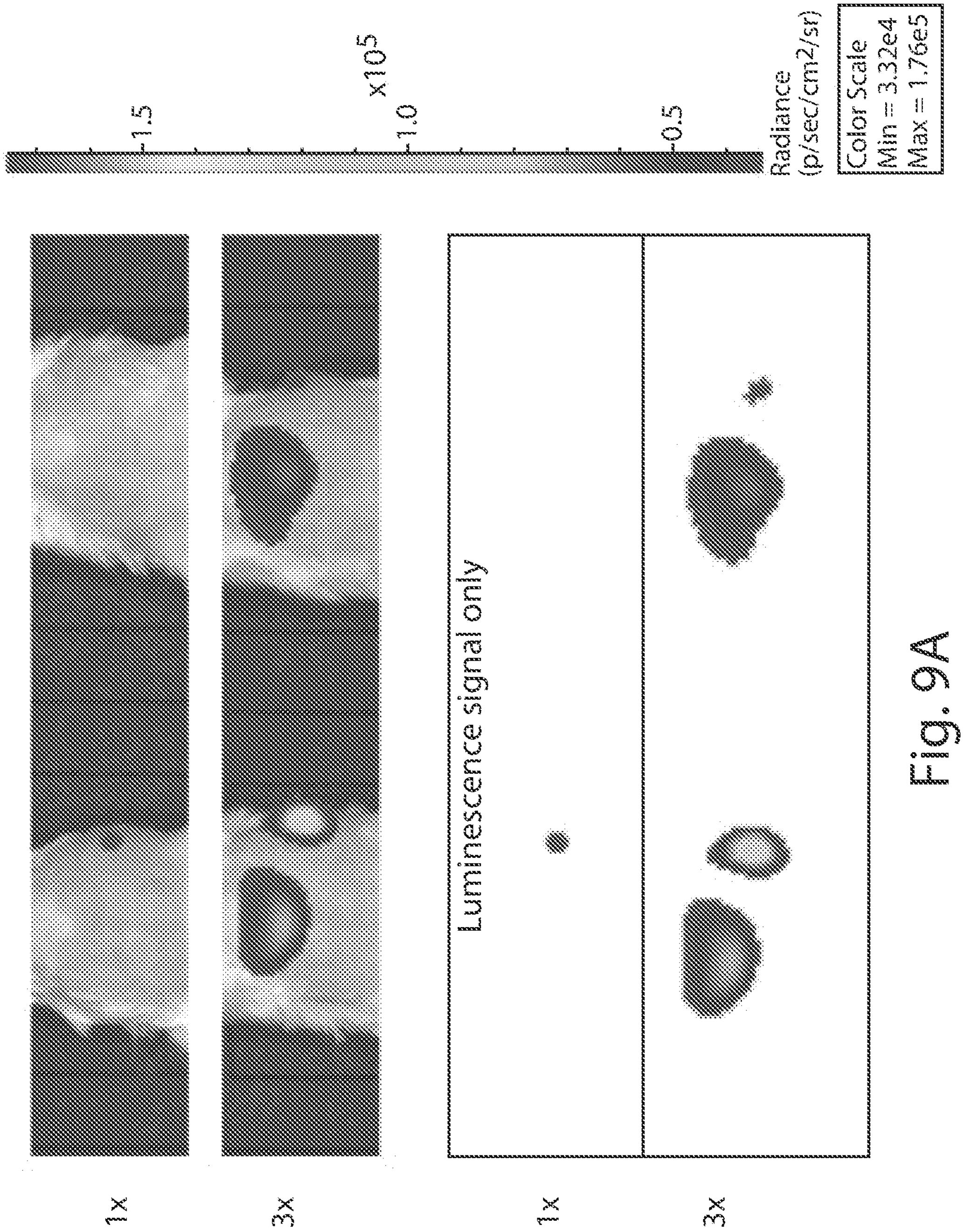
FIGS. 9A-9B are a series of diagrams showing Cre recombinase delivery by fusosomes as detected by bioluminescent imaging in mice. (A) Ventral image and luminescent signal overlay of exposed liver and spleen of IV fusosome treated mice (1× and 3× concentration). Lower portion is luminescent signal alone. (B) Total flux signal of fusosome targeted spleen and liver; y-scale is on log 10 scale. Mice treated with a concentration of 3× fusosome treatment had a significantly greater signal in the spleen ($p=0.0004$) than background 72 hours post-treatment.
Figure 9B:
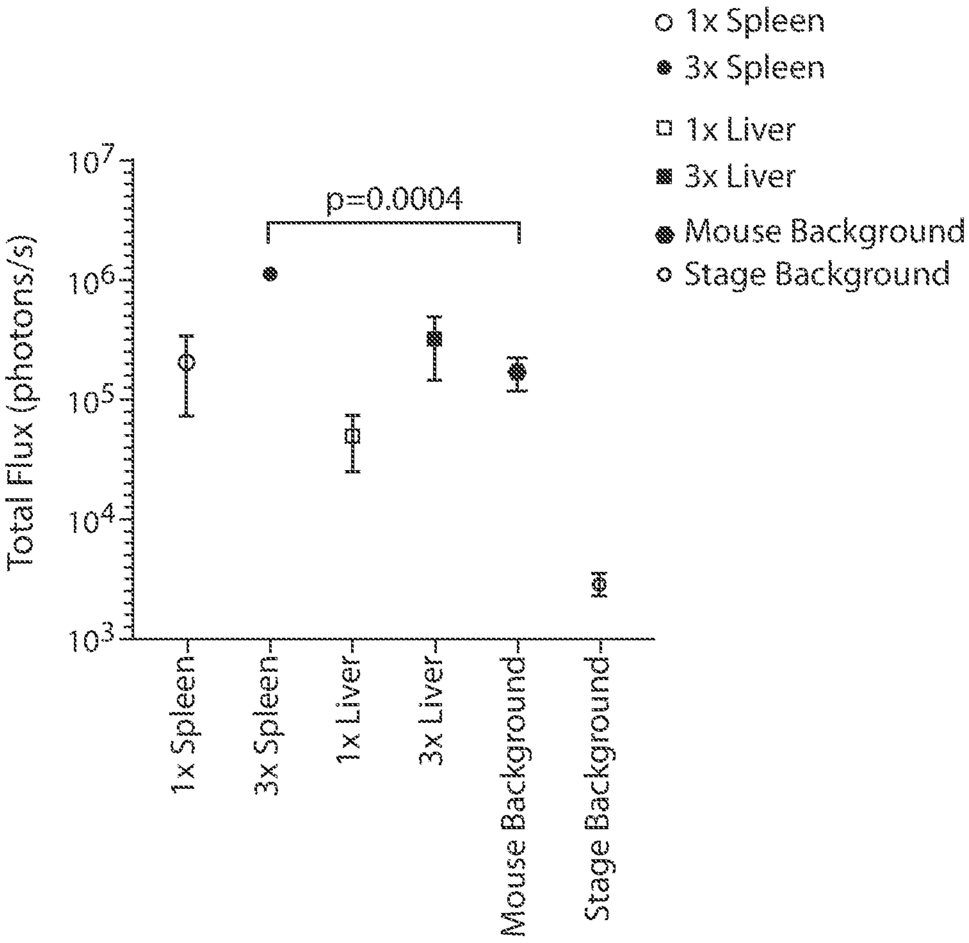

Evidence of protein (Cre recombinase) delivery by fusosomes was detected by bioluminescent imaging in the recipient tissue of the animal, as shown in FIGS. 9A-9B. Signal was seen primarily in the spleen and liver, with the 3× group showing the highest signal.

Figure 10A:
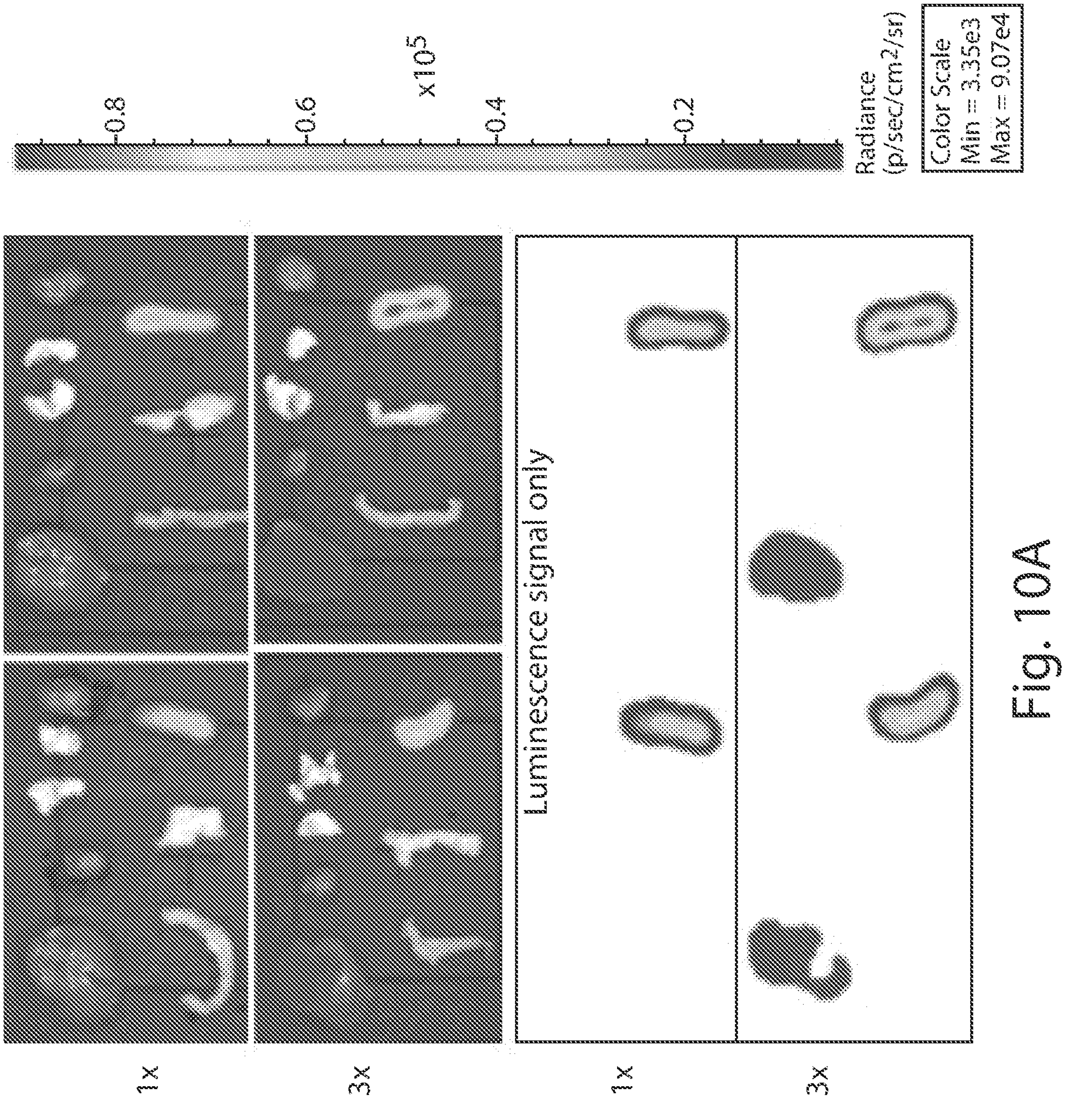
FIGS. 10A-10B are a series of diagrams showing Cre recombinase to murine liver and spleen by fusosomes as detected by bioluminescent imaging. (A) From left to right; dorsal image and luminescent signal overlay of excised liver, heart, lungs, kidney, small intestines, pancreas, and spleen collected and imaged within 5 minutes of euthanasia. Lower portion is luminescent signal alone. (B) Total flux signal of fusosome targeted spleen and liver and other tissues; y-scale is on log 10 scale. Mice treated with a concentration of 3× fusosome treatment had a significantly greater signal in the spleen ($p<0.0001$) as compared to the tissue with the lowest signal (heart).
Figure 10B:
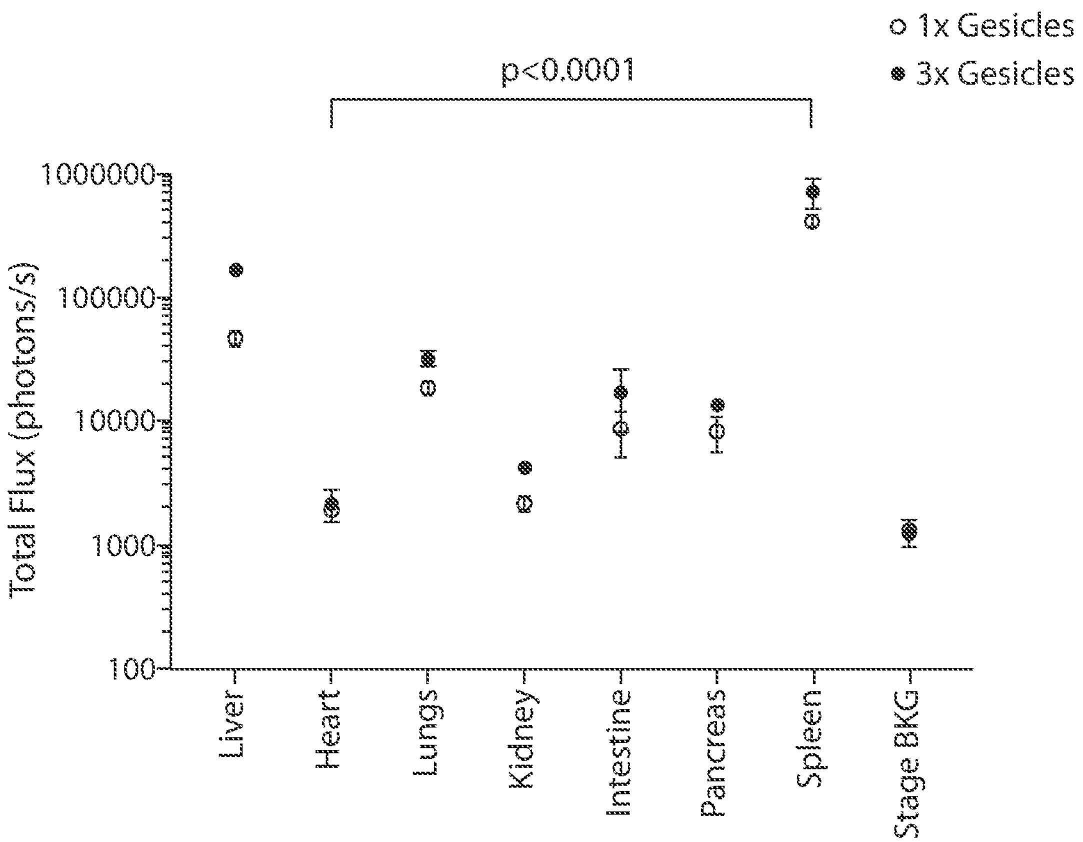

Following whole body imaging, mice were cervically dislocated and liver, heart, lungs, kidney, small intestines, pancreas, and spleen were collected and imaged within 5 minutes of euthanasia. Evidence of protein (Cre recombinase) delivery to the liver and spleen by fusosomes was detected by bioluminescent imaging in the extracted recipient tissue of the animals. This can be seen in FIGS. 10A-10B. Signal was highest in spleen and the lowest in heart, with the 3× group showing the highest significant signal ($p=0.0004$ as compared to heart).

Example 80: Delivery of Fusosomes Via a Pathway that is Independent of Lysosome Acidification Often, entry of complex biological cargo into target cells is accomplished by endocytosis. Endocytosis requires the cargo to enter an endosome, which matures into an acidified lysosome. Disadvantageously, cargo that enters a cell through endocytosis may become trapped in an endosome or lysosome and be unable to reach the cytoplasm. The cargo may also be damaged by acidic conditions in the lysosome. Some viruses are capable of non-endocytic entry into target cells; however this process is incompletely understood. This example demonstrates that a viral fusogen can be isolated from the rest of the virus and confer non-endocytic entry on a fusosome that lacks other viral proteins.

Fusosomes from HEK-293T cells expressing the Nipah virus receptor-binding G protein and fusion F protein (NivG+F) on the cell surface and expressing Cre recombinase protein were generated according by the standard procedure of ultracentrifugation through a FICOLL™ gradient to obtain small particle fusosomes, as described herein. To demonstrate delivery of the fusosome to a recipient cell via a non-endocytic pathway, the NivG+F fusosomes were used to treat recipient HEK-293T cells engineered to express a "Loxp-GFP-stop-Loxp-RFP" cassette under CMV promoter. NivF protein is a pH-independent envelope glycoprotein that has been shown to not require environmental acidification for activation and subsequent fusion activity (Tamin, 2002).

The recipient cells were plated 30,000 cells/well into a black, clear-bottom 96-well plate. Four to six hours after plating the recipient cells, the NivG+F fusosomes expressing Cre recombinase protein were applied to the target or non-target recipient cells in DMEM media. The fusosome sample was first measured for total protein content by bicinchoninic acid assay (BCA, ThermoFisher, Cat #23225) according to manufacturer's instructions. Recipient cells were treated with 10 μg of fusosomes and incubated for 24 hrs at 37° C. and 5% $CO_2$. To demonstrate that Cre delivery via NivG+F fusosomes was through a non-endocytic pathway, a parallel wells of recipient cells receiving NivG+F fusosome treatment were co-treated with an inhibitor of endosome/lysosome acidification, bafilomycin Al (Baf; 100 nM; Sigma, Cat #B1793).

Cell plates were imaged using an automated microscope (biotek.com/products/imaging-microscopy-automated-cell-imagers/lionheart-fx-automated-live-cell-imager/). The total cell population in a given well was determined by staining the cells with Hoechst 33342 in DMEM media for 10 minutes. Hoechst 33342 stains cell nuclei by intercalating into DNA and was therefore used to identify individual cells. Hoechst staining was imaged using the 405 nm LED and DAPI filter cube. GFP was imaged using the 465 nm LED and GFP filter cube, while RFP was imaged using the 523 nm LED and RFP filter cube. Images of target and non-target cell wells were acquired by first establishing the LED intensity and integration times on a positive control well containing recipient cells treated with adenovirus coding for Cre recombinase instead of fusosomes.

Acquisition settings were set so that Hoescht, RFP, and GFP intensities were at the maximum pixel intensity values but not saturated. The wells of interest were then imaged using the established settings. Focus was set on each well by autofocusing on the Hoescht channel and then using the established focal plane for the GFP and RFP channels. Analysis of GFP and RFP-positive cells was performed with Gen5 software provided with automated fluorescent microscope (biotek.com/products/software-robotics-software/gen5-microplate-reader-and-imager-software/).

The images were pre-processed using a rolling ball background subtraction algorithm with a 60 μm width. Cells with GFP intensity significantly above background intensities were thresholded and areas too small or large to be GFP-positive cells were excluded. The same analysis steps were applied to the RFP channel. The number of RFP-positive cells (recipient cells receiving Cre) was then divided by the sum of the GFP-positive cells (recipient cells that did not show delivery) and RFP-positive cells to quantify the percentage RFP conversion, which indicates the amount of fusosome fusion with the recipient cells.

With this assay, the fusosome derived from a HEK-293T cell expressing NivG+F on its surface and containing Cre recombinase protein showed significant delivery via a lysosome-independent pathway, which is consistent with entry via a non-endocytic pathway, as evidenced by a significant delivery of Cre cargo by NivG+F fusosomes even when recipient cells were co-treated with Baf to inhibit endocytosis-mediated uptake (FIG. 11). In this case, the inhibition of cargo delivery by Baf co-treatment was 23.4%.

Example 81: Measuring Ability to Polymerize Actin for Mobility

Fusosomes were generated by the standard procedure of harvesting and preparing fusosomes produced from HEK-293T cells expressing the envelope glycoprotein G from vesicular stomatitis virus (VSV-G) on the cell surface, as described herein. Control particles (non-fusogenic fusosomes) were produced from HEK-293T cells reverse transiently transfected with pcDNA3.1 empty vector. Fusosomes and parental cells were then assayed for their ability to polymerize actin (over time) using a rhodamine phalloidin-flow cytometry assay and Tubulin ELISA. Briefly, approximately $1\times10^6$ fusosomes corresponding to 60 μL of a standard VSV-G fusosome preparation and $1\times10^5$ parent cells used to generate the fusosomes were plated in 1 mL of complete media in a 96 well low-attachment multi-well plate in complete and incubated at 37° C. and 5% $CO_2$. Samples were taken periodically, at 3 hr, 5 hr and 24 hr post plating. Samples were centrifuged at 21,000×g for 10 mins, re-suspended in 200 μL 4% (v/v) PFA in phosphate buffered saline for 10 mins, washed with 1 mL of phosphate buffered saline, centrifuged at 21,000×g for 10 mins, washed again and stored at 4° C. until further use.

For rhoamine-phalloidin staining, samples were centrifuged at 21,000×g for 10 mins, and incubated in 100 μL of 0.1% (v/v) TRITON™ X-100 in phosphate buffered saline for 20 mins. Following the 20-min incubation, an additional 100 μL of 0.1% (v/v) TRITON™ X-100 in phosphate buffered saline containing 165 μM rhodamine-phalloidin was added to the sample and pipette mixed, negative control received and additional 100 μL of 100 μL of 0.1% (v/v) TRITON™ X-100 in phosphate buffered saline only. Samples were incubated for 45 mins before being washed with 1 mL of phosphate buffered saline, centrifuged at 21,000×g for 10 mins, washed again and re-suspended in 300 μL of phosphate buffered saline and analyzed by flow cytometry (ATTUNE™, ThermoFisher) using a 561 nm laser for excitation, and 585+/−16 nm filter emission, as shown in Table 13 below:

TABLE 13

Flow cytometer settings

| Dye | ATTUNE ™ Laser/Filter | Laser Wavelength | Emission Filter (nm) |
|---|---|---|---|
| AF47 | YL1 | 585 | 585/16 |

Figure 2:
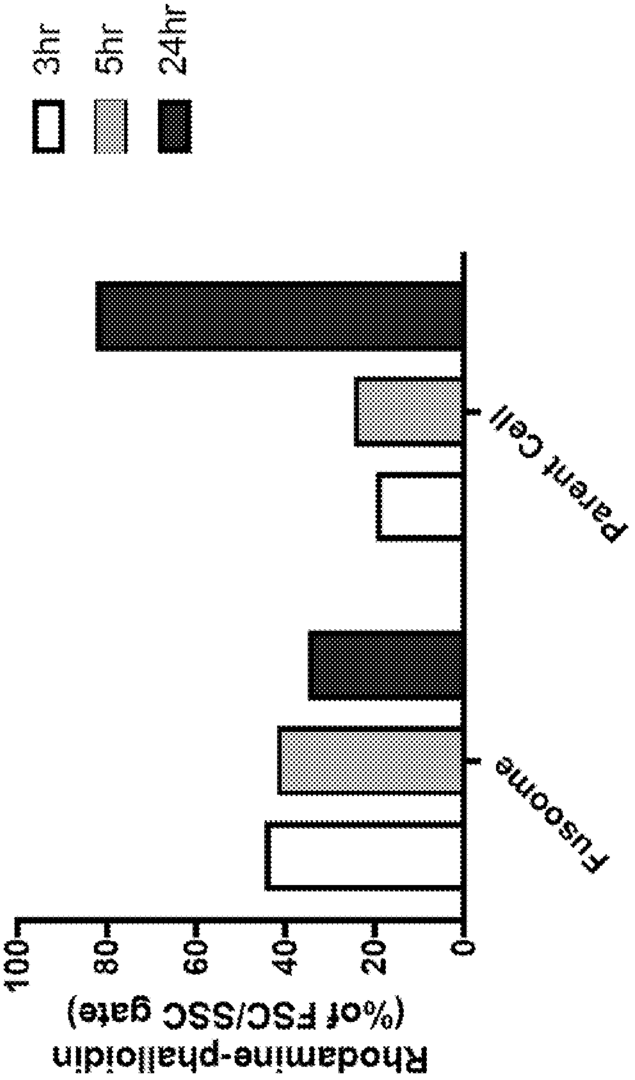
FIG. 2 is a graph showing the capacity for fusosomes and parent cells to polymerase actin over a period of 3, 5, and 24 hours.

ATTUNE™ NxT software was used for acquisition and FlowJo used analysis. For data acquisition the FSC and SSC channels were set on linear axis to determine a population representative of the cells or fusosomes. This population was then gated and events only inside this gate were used to display events in the 585+/−16 nm emission channel on a logarithmic scale. A minimum of 10,000 events within the cells or fusosomes gate was collected for in each condition. For data analysis, the FSC and SSC channels were set on linear axis to determine a population representative of the cells or fusosomes. This population was then gated and events only inside this gate were used to display events in the 585+/−16 nm emission channel on a logarithmic scale. The negative control 585+/−16 nm emission was used to determine where to place the gate on the histogram such that it was less the gate include less than 1% positive. Using analysis criteria listed above parent cells demonstrated 19.9%, 24.8% and 82.5% rhodamine-phalloidin positive events, at the 3 hr, 5 hr and 24 hr time-points, respectively. The fusosomes were 44.6%, 41.9% and 34.9% rhodamine-phalloidin at the 3 hr, 5 hr and 24 hr time-points, respectively (FIG. 2). This example demonstrates that fusosomes do not increase in amount of actin over time, whereas the parent cells do.

Example 82: Measuring GAPDH in Fusosomes

This example describes quantification of the level of glyceraldehyde 3-phosphate dehydrogenase (GAPDH) in the fusosomes, and the relative level of GAPDH in the fusosomes compared to the parental cells. Fusosomes were prepared as described in Examples 67 and 86.

GAPDH was measured in the parental cells and the fusosomes using a standard commercially available ELISA for GAPDH (ab176642, ABCAM™) per the manufacturer's directions. Total protein levels were similarly measured via bicinchoninic acid assay. Measured GAPDH and protein levels are shown in Table 14 below:

TABLE 14

Measured GAPDH and protein levels

| | [Protein] (mg/mL) | [GAPDH] (ng/ml) | GAPDH:Protein (μg/g) |
|---|---|---|---|
| Fusosomes | 0.82 | 37.2 | 45.3 |
| Cells | 0.45 | 50.4 | 112.0 |

Figure 12:
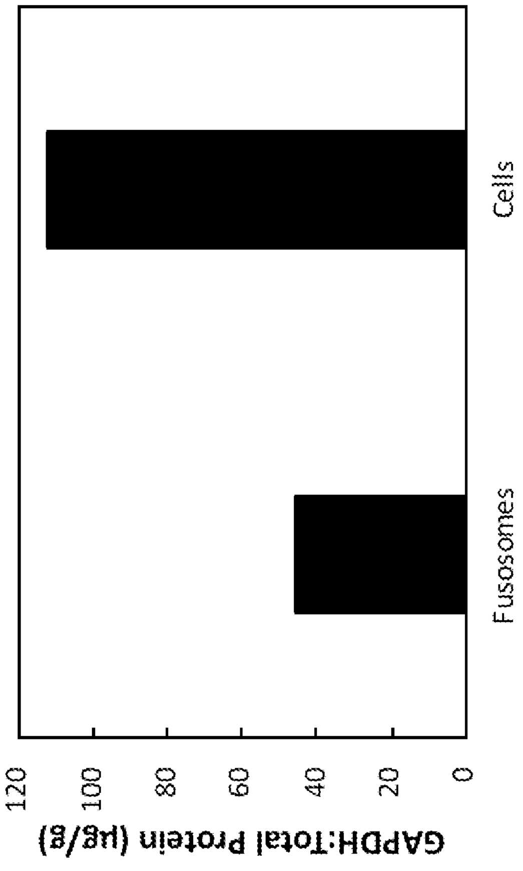
FIG. 12 is a graph showing GAPDH: Total protein ratios measured by bicinchoninic acid assay in fusosomes and parental cells.

GAPDH: Total protein ratios are also shown in FIG. 12.

Example 83: Ratio of Lipids to Proteins in Fusosomes

This Example describes quantification of the ratio of lipid mass to protein mass in fusosomes. It is contemplated that fusosomes can have a ratio of lipid mass to protein mass that is similar to that of nucleated cells. Fusosomes and parental cells were prepared as described herein in Examples 67 and 86.

Figure 13:
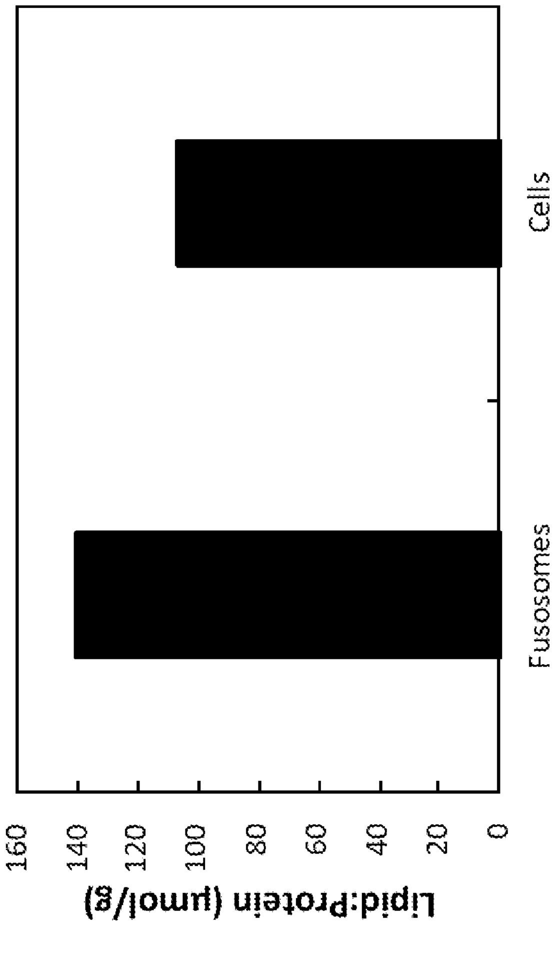
FIG. 13 is a graph showing lipid: protein ratios measured by bicinchoninic acid assay in fusosomes and parental cells.

The lipid content was calculated using choline-containing phospholipids as a subset of total lipids using a commercially available phospholipid assay kit (MAK122 Sigma St. Louis, MO) according to manufacturer's instructions. Total protein content of the fusosomes was measured via bicinchoninic acid assay as described herein. Measured phospholipid levels, protein levels, and the ratio of phospholipids to protein are shown in FIG. 13 and Table 15 below:

TABLE 15

Measured phospholipid levels, protein levels, and ratio of phospholipids to protein

| | Phospholipids (μM) | Protein (g/L) | Phospholipids:Protein (μmol/g) |
|---|---|---|---|
| Fusosomes | 115.6 | 0.82 | 141.0 |
| Cells | 47.9 | 0.45 | 106.4 |

Example 84: Ratio of Proteins to DNA in Fusosomes

Figure 14:
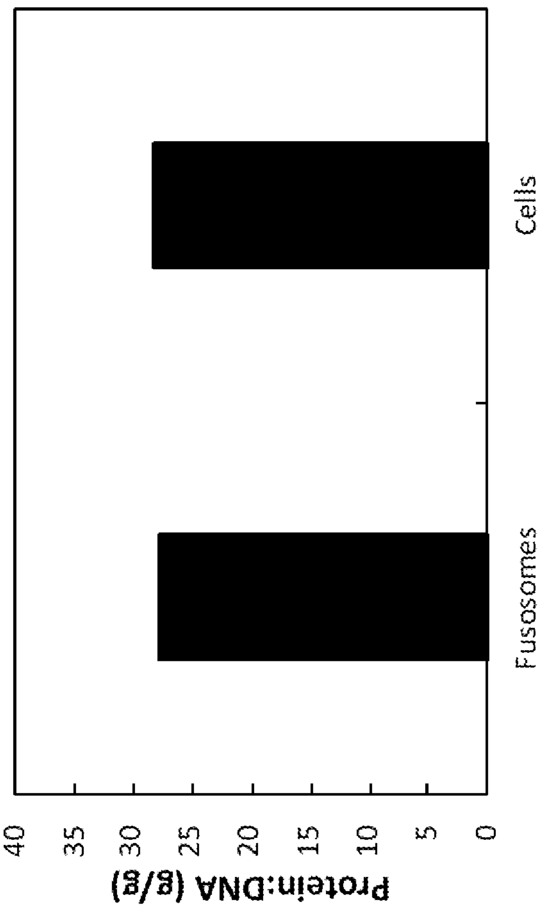
FIG. 14 is a graph showing protein: DNA ratios measured by bicinchoninic acid assay in fusosomes and parental cells.

This Example describes quantification of the ratio of protein mass to DNA mass in fusosomes. It is contemplated that fusosomes can have a ratio of protein mass to DNA mass that is much greater than that of cells. Fusosomes were prepared as described in Examples 67 and 86. Total protein content of the fusosomes and cells was measured via bicinchoninic acid as described herein. The DNA mass of fusosomes and cells were measured by absorption at 280 nm after extraction of total DNA using a commercially available isolation kit (#69504 Qiagen Hilden, Germany) according to the manufacturer's instructions. The ratio of proteins to total nucleic acids was determined by dividing the total protein content by the total DNA content to yield a ratio within a given range for a typical fusosome preparation. Measured protein levels, DNA levels, and the ratio of protein to DNA are shown in FIG. 14 and Table 16 below:

TABLE 16

Measured protein levels, DNA levels, and ratio of protein to DNA

| | [Protein] (mg/mL) | [DNA] (ng/μL) | Protein:DNA (g/g) |
|---|---|---|---|
| Fusosomes | 0.82 | 29.5 | 27.8 |
| Cells | 0.45 | 15.9 | 28.3 |

Example 85: Ratio of lipids to DNA in fusosomes

This Example describes quantification of the ratio of lipids to DNA in fusosomes compared to parental cells. In an embodiment, fusosomes will have a greater ratio of lipids to DNA compared to parental cells. Fusosomes were prepared as described previously in Examples 67 and 86.

Figure 15:
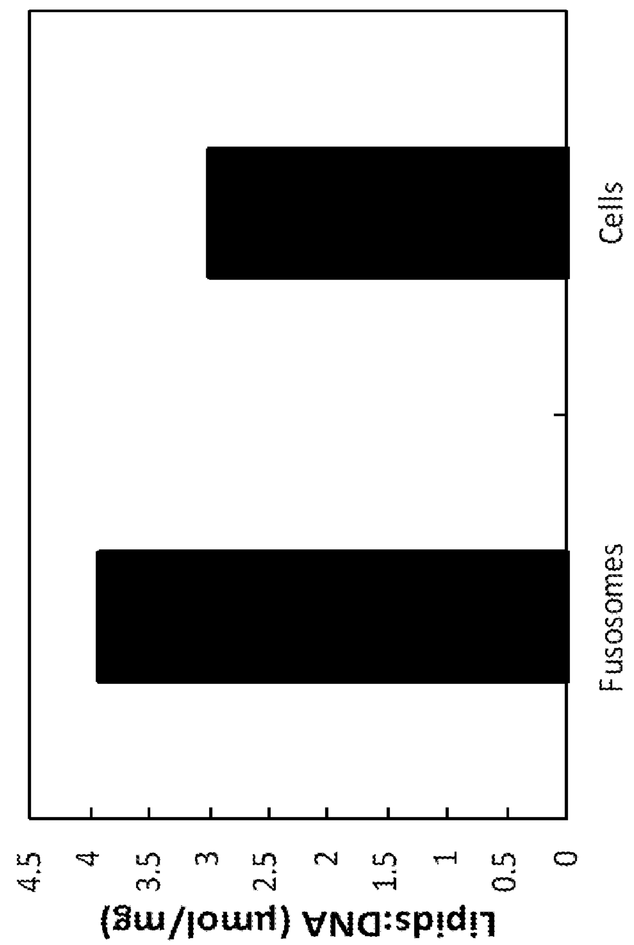
FIG. 15 is a graph showing lipids: DNA ratios measured by bicinchoninic acid assay in fusosomes and parental cells.

This ratio is defined as the lipid content outlined in Example 40, and nucleic acid content is determined as described in Example 41. Measured lipid levels, DNA levels, and the ratio of lipid to DNA are shown in FIG. 15 and Table 17 below:

TABLE 17

Measured lipid levels, DNA levels, and ratio of lipid to DNA

| | [Lipids] (μM) | [DNA] (ng/μL) | Lipids:DNA (μmol/mg) |
|---|---|---|---|
| Fusosomes | 115.6 | 29.5 | 3.92 |
| Cells | 47.9 | 15.9 | 3.01 |

Example 86: Measuring Lipid Composition in Fusosomes

This Example describes quantification of the lipid composition of fusosomes. It is contemplated that the lipid composition of fusosomes can be similar to the cells from which they are derived. Lipid composition affects important biophysical parameters of fusosomes and cells, such as size, electrostatic interactions, and colloidal behavior.

The lipid measurements were based on mass spectrometry. Fusosomes were prepared as described herein by transient transfection of VSV-G and GFP in 10 cm dishes, followed by filtration and ultracentrifugation of the conditioned media 48 h after transfection to obtain fusosomes. Transfected cells were harvested in parallel to the conditioned media and submitted for analysis. Exosomes were also harvested from cells that were not transfected with VSV-G or GFP.

Mass spectrometry-based lipid analysis was performed by Lipotype GmbH (Dresden, Germany) as described (Sampaio et al. 2011). Lipids were extracted using a two-step chloroform/methanol procedure (Ejsing et al. 2009). Samples were spiked with internal lipid standard mixture containing: cardiolipin 16:1/15:0/15:0/15:0 (CL), ceramide 18:1; 2/17:0 (Cer), diacylglycerol 17:0/17:0 (DAG), hexosylceramide 18:1; 2/12:0 (HexCer), lyso-phosphatidate 17:0 (LPA), lyso-phosphatidylcholine 12:0 (LPC), lyso-phosphatidylethanolamine 17:1 (LPE), lyso-phosphatidylglycerol 17:1 (LPG), lyso-phosphatidylinositol 17:1 (LPI), lyso-phosphatidylserine 17:1 (LPS), phosphatidate 17:0/17:0 (PA), phosphatidylcholine 17:0/17:0

(PC), phosphatidylethanolamine 17:0/17:0 (PE), phosphatidylglycerol 17:0/17:0 (PG), phosphatidylinositol 16:0/16:0 (PI), phosphatidylserine 17:0/17:0 (PS), cholesterol ester 20:0 (CE), sphingomyelin 18:1; 2/12:0; 0 (SM), triacylglycerol 17:0/17:0/17:0 (TAG) and cholesterol D6 (Chol).

After extraction, the organic phase was transferred to an infusion plate and dried in a speed vacuum concentrator. 1st step dry extract was re-suspended in 7.5 mM ammonium acetate in chloroform/methanol/propanol (1:2:4, V: V: V) and 2nd step dry extract in 33% ethanol solution of methylamine in chloroform/methanol (0.003:5:1; V: V: V). All liquid handling steps were performed using Hamilton Robotics STARlet robotic platform with the Anti Droplet Control feature for organic solvents pipetting.

Samples were analyzed by direct infusion on a QExactive mass spectrometer (Thermo Scientific) equipped with a TriVersa NanoMate ion source (Advion Biosciences). Samples were analyzed in both positive and negative ion modes with a resolution of $R_{m/z}$=200=280000 for MS and $R_{m/z}$=200=17500 for MSMS experiments, in a single acquisition. MSMS was triggered by an inclusion list encompassing corresponding MS mass ranges scanned in 1 Da increments (Surma et al. 2015). Both MS and MSMS data were combined to monitor CE, DAG and TAG ions as ammonium adducts; PC, PC O—, as acetate adducts; and CL, PA, PE, PE O—, PG, PI and PS as deprotonated anions. MS only was used to monitor LPA, LPE, LPE O—, LPI and LPS as deprotonated anions; Cer, HexCer, SM, LPC and LPC O— as acetate adducts and cholesterol as ammonium adduct of an acetylated derivative (Liebisch et al. 2006).

Data were analyzed with in-house developed lipid identification software based on LipidXplorer (Herzog et al. 2011; Herzog et al. 2012). Data post-processing and normalization were performed using an in-house developed data management system. Only lipid identifications with a signal-to-noise ratio >5, and a signal intensity 5-fold higher than in corresponding blank samples were considered for further data analysis.

Fusosome lipid composition was compared to lipid compositions of parental cells, with undetected lipid species assigned a value of zero. The lipid species identified in fusosomes and parental cells are shown in Table 18 below:

TABLE 18

| Lipid species identified in fusosomes and parental cells | | | | |
|---|---|---|---|---|
| | Total Lipid Species Identified | Shared Lipid Species (identified in both parental cells and fusomes) | Shared Lipid Species with 25% of parental expression in fusosomes | Fraction of Shared Lipid Species to Total Lipids |
| Fusosomes | 679 | 569 | 548 | 0.700 |
| Parental Cells | 783 | | | |

It is contemplated that fusosomes and parental cells can have a similar lipid composition if ≥70% of the lipid species identified in any replicate sample of the parental cells are present in any replicate sample of the fusosomes, and of those identified lipids, the average level in the fusosome can be >25% of the corresponding average lipid species level in the parental cell.

Example 87: Measuring Proteomic Composition in Fusosomes

This Example describes quantification of the protein composition of fusosomes. It is contemplated that the protein composition of fusosomes can be similar to the parental cells from which they are derived.

Fusosomes and parental cells were prepared as described herein by the method of Examples 67 and 86.

Each sample was resuspended in lysis buffer (6 M urea, 2 M thiourea, 4% CHAPS, 50 mM Tris pH 8.0), sonicated on an ice bath and ran through a small gauge syringe. Proteins were reduced with 10 mM DTT for 15 minutes at 65° C. and alkylated with 15 mM iodoacetamide (IAA) for 30 minutes in the dark at room temperature. Excess IAA was quenched with an additional 10 mM DTT. Proteins were then precipitated with the addition of 8 volumes of ice cold acetone+1 volume of ice cold methanol and placed at −80° C. overnight. The precipitated proteins were pelleted by centrifugation. Remaining lysis buffer was washed with 200 μl of ice cold methanol 3 times. Proteins were resuspended in 0.75 M urea+50 mM Tris pH 8.0±1 μg Trypsin/LysC and pre-digested for 4 hours at 37° C. with agitation. An additional 1 μg of trypsin/LysC was added to the proteins and the digestion was continued overnight. Peptides were purified by reversed phase SPE and analyzed by LC-MS.

A replicate sample for each condition was lysed and combined in one tube. This pool was then either subjected to the same preparation protocol as the samples and analyzed by LC-MS in information dependent acquisition or separated on a gel as described below.

A total of 100 μg of pooled proteins was placed in 2× Laemmli loading buffer and separated on a 12.5% SDS PAGE. Proteins were briefly stained with Coomassie blue and the protein lanes were separated into 12 fractions. Each fraction was then dehydrated with 50% acetonitrile and rehydrated with 10 mM DTT for the reduction. Gel pieces were placed at 65° C. for 15 minutes and alkylated for 30 minutes at room temperature with 15 mM IAA in the dark. Gels were further dehydrated with 50% acetonitrile and rehydrated in 50 mM Tris pH 8 with 1 μg of trypsin/LysC overnight at 37° C. Peptides were extracted from the gel by dehydration and sonication. Peptides were purified by reversed phase SPE and analyzed by LC-MS/MS (1×IDA per fraction).

Acquisition was performed with an AB SCIEX™ TripleTOF 5600 (AB SCIEX™, Foster City, CA, USA) equipped with an electrospray interface with a 25 μm iD capillary and coupled to an Eksigent μUHPLC (Eksigent, Redwood City, CA, USA). Analyst TF 1.7 software was used to control the instrument and for data processing and acquisition. Acquisition was performed in Information Dependent Acquisition (IDA) mode for the 12 fractions from the gel or the unfractionated pool. The samples were analyzed in SWATH acquisition mode. For the IDA mode, the source voltage was set to 5.2 kV and maintained at 225° C., curtain gas was set at 27 psi, gas one at 12 psi and gas two at 10 psi. For the SWATH mode, the source voltage was set to 5.5 kV and maintained at 225° C., curtain gas was set at 25 psi, gas one at 16 psi and gas two at 15 psi. Separation was performed on a reversed phase HALO C18-ES column 0.3 mm i.d., 2.7 μm particles, 150 mm long (Advance Materials Technology, Wilmington, DE) which was maintained at 60° C. Samples were injected by loop overfilling into a 5 μL loop. For the 60 minutes LC gradient, the mobile phase consisted of the following solvent A (0.2% v/v formic acid and 3% DMSO v/v in water) and solvent B (0.2% v/v formic acid and 3% DMSO in EtOH) at a flow rate of 3 μL/min.

To generate the ion library for the analysis of the samples, the ProteinPilot software was run on the wiff files that were generated by the IDA runs. This database was used in the Peakview software (AB SCIEX™) to quantify the proteins in each of the samples, using 3 transition/peptide and 15 peptide/protein. To maximize the number of quantified proteins, the samples were quantified on a publicly available human SWATH database (Atlas) with the same parameters. A peptide was considered as adequately measured if the score computed by Peakview was superior to 1.5 and had an FDR <1%. The quantification from each of the database was combined into one final quantification using the protein name from both databases. A correction factor was computed for every sample by taking into account the total signal of every protein in that sample when compared to the average of the total signal for every sample.

The fusosome proteomic composition was compared to the parental cell proteomic composition. A similar proteomic composition between fusosomes and parental cells was observed when >33% of the identified proteins were present in the fusosome, and of those identified proteins, the level was >25% of the corresponding protein level in the parental cell, as shown in Table 19 below.

TABLE 19

| Comparison of fusosome proteomic composition and parental cell proteomic composition | | | | |
|---|---|---|---|---|
| | Total Proteins Identified | Shared proteins (identified in both parental cells and fusomes) | Shared proteins with 25% of parental expression in fusosomes | Fraction of shared proteins to total proteins |
| Fusosomes | 1926 | 1487 | 957 | 0.333 |
| Cells | 2870 | | | |

Example 88: Quantifying an Endogenous or Synthetic Protein Level Per Fusosome This example describes quantification of an endogenous or synthetic protein cargo in fusosomes. Fusosomes can, in some instances, comprise an endogenous or synthetic protein cargo. The fusosome or parental cell described in this Example was engineered to alter the expression of an endogenous protein or express a synthetic cargo that mediates a therapeutic or novel cellular function.

Fusosomes and parental cells expressing GFP were prepared as described herein by the method of Examples 67 and 86. Quantification of GFP in fusosomes was accomplished using a commercially available ELISA kit (ab171581 ABCAM™ Cambridge, United Kingdom) according to the manufacturer's instructions. Fusosome quantification was performed by Nanoparticle Tracking Analysis using a NANOSIGHT™ NS300 (Malvern Instruments, Malvern, Worcestershire, United Kingdom). Results are shown in Table 20 below.

TABLE 20

| Quantification of GFP in fusosomes | |
|---|---|
| | Concentration (#/mL) |
| GFP Protein | $4.41 \times 10^{13}$ |
| Fusosomes | $2.66 \times 10^{11}$ |
| GFP:Fusosome | 165.8 |

It is contemplated that the fusosomes can have at least 1, 2, 3, 4, 5, 10, 20, 50, 100, or more protein agent molecules per fusosome. In an embodiment, the fusosomes will have 166 protein agent molecules per fusosome.

Example 89: Measuring Markers of Exosomal Proteins in Fusosomes

This assay describes quantification of the proportion of proteins that are known to be specific markers of exosomes.

Fusosomes were prepared as described herein by the method of Examples 67 and 86. Exosomes were prepared as described herein for fusosomes by the method of Examples 67 and 86 with the exception that the parental cells were not transfected with VSV-G or GFP. Protein quantification by mass spectrometry for fusosomes and exosomes was performed as described herein in Example 35.

Figure 16:
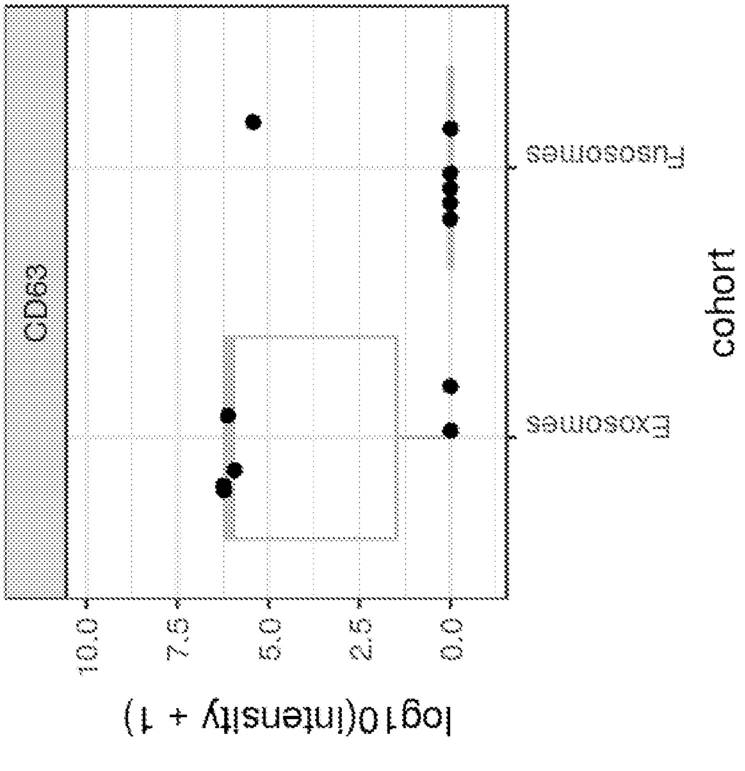
FIG. 16 is a graph showing protein levels of the exosome marker CD63 in exosomes and fusosomes.

The resulting protein quantification data was analyzed to determine protein levels and proportions of the known exosomal marker CD63. Average log intensities per group were calculated by adding 1 to intensity values from mass spectrometry, transforming by log 10, and computing the mean across replicates. The results are shown in FIG. 16.

Example 90: Measuring Calnexin in Fusosomes

This assay describes quantification of the level of calnexin (CNX) in the fusosomes, and the relative level of CNX in the fusosomes compared to the parental cells.

Figure 17:
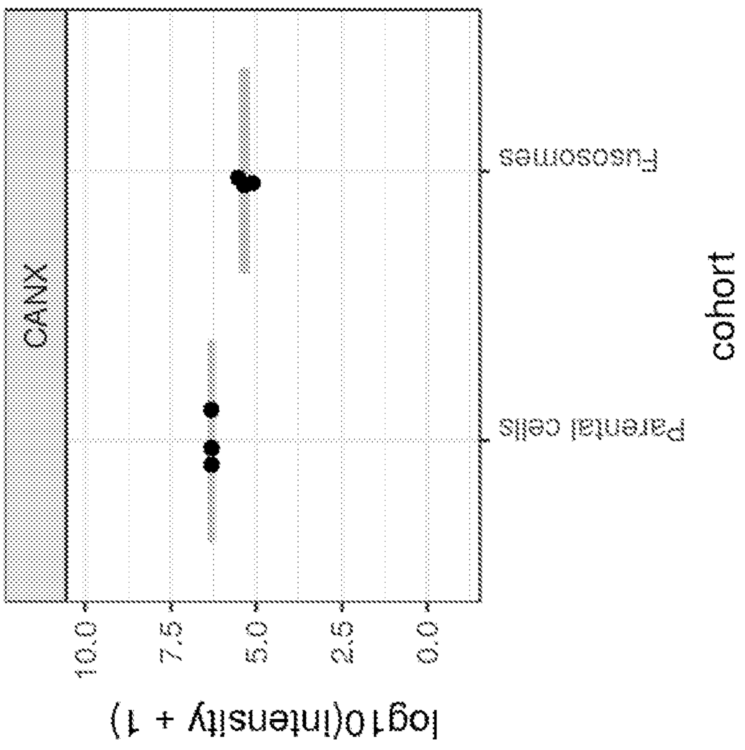
FIG. 17 is a graph showing the intensity of calnexin signal detected in fusosomes and parental cells.

Fusosomes and parental cells were prepared as described herein in Examples 67 and 86. Calnexin and total protein was measured using mass spectrometry conducted according to the method of Example 35. The calnexin signal intensity determined for parental cells and fusosomes is shown in FIG. 17.

In embodiments, using this assay, the average fractional content (calculated as described herein in Example 35) of CNX in the fusosomes will be <2.43x10-4.

In an embodiment, the decrease in calnexin per total protein in ng/ug from the parent cell to the preparation will be more than 88%.

Example 91: Ratio of Lipids to DNA in Fusosomes

This Example describes quantification of the ratio of lipids to DNA in fusosomes compared to parental cells. In an embodiment, fusosomes will have a greater ratio of lipids to DNA compared to parental cells. Fusosomes were prepared as described previously in Examples 67 and 86.

Figure 18:
FIG. 18 is a graph showing lipid: DNA ratios determined for fusosomes and parental cells.

This ratio is defined as the lipid content outlined in Example 40, and nucleic acid content is determined as described in Example 41. As shown in FIG. 18 and in Table 21 below, fusosomes were found to exhibit a greater lipid: DNA ratio than parental cells.

TABLE 21

| Lipid to DNA ratio in fusosomes and parental cells | | | |
|---|---|---|---|
| | [Lipids] (μM) | [DNA] (ng/μL) | Lipids:DNA (μmol/mg) |
| Fusosomes | 115.6 | 29.5 | 3.92 |
| Cells | 47.9 | 15.9 | 3.01 |

Example 92: Analyzing Surface Markers on Fusosomes

This assay describes identification of surface markers on the fusosomes.

Fusosomes were prepared as described herein in Examples 67 and 86. Phosphatidylserine was measured by mass spectrometry as described herein in Examples 67 and 86. The quantity of phosphatidylserine relative to total lipids in fusosomes was determined to be 121% greater than the quantity of phosphatidylserine relative to total lipid in parental cells, as shown in Table 22 below.

TABLE 22

| Quantity of phosphatidylserine relative to total lipids in fusosomes and parental cells | | |
|---|---|---|
| | Phosphatidylserine (molar %) | Phosphatidylserine Percent change |
| Fusosomes | 14.6 | 121% |
| Parental Cells | 6.6 | |

Example 93: Analysis of Viral Capsid Proteins in Fusosomes

In this example, the makeup of the sample preparation was analyzed and the proportion of proteins that are derived from viral capsid sources was assessed.

Fusosomes were prepared as described herein by the method of Examples 67 and 86. Protein quantification by mass spectrometry for fusosomes was performed as described herein in Example 35. The fractional content of the viral capsid proteins was calculated as described herein in Example 35, averaged over fusosome samples, and expressed as a percent.

Using this approach, the sample was found to contain 0.05% viral capsid protein, as shown in Table 23 below. The only viral capsid protein detected was Complex of Rabbit Endogenous Lentivirus (RELIK) Capsid with Cyclophilin A (PDB 2XGY|B).

TABLE 23

| Quantification of Percentage of Viral Capsid Protein to Total Protein | | |
|---|---|---|
| | Raw MS Intensity | Viral:Total Protein (%) |
| Viral Capsid Proteins | $5.10 \times 10^5$ | 0.05 |
| Total Proteins | $9.46 \times 10^8$ | |

Example 94: Quantification of Fusogen Protein Ratios in Fusosomes

This example describes quantification of the ratio of fusogen protein to total protein or other proteins of interest in fusosomes. Other proteins of interest may include, but are not limited to, EGFP, CD63, ARRDC1, GAPDH, Calnexin (CNX), and TSG101. Fusosomes were prepared as described herein by the method of Examples 67 and 86. Protein quantification by mass spectrometry for fusosomes was performed as described herein in Example 35. The quantification of all proteins was calculated as described herein in Example 35, averaged over fusosome samples, and expressed as a fraction.

As shown in Table 24 below, the fusogen was found to have a ratio to EGFP of 156.9, a ratio to CD63 of 2912.0, a ratio to ARRDC1 of 664.9, a ratio to GAPDH of 69.0, a ratio to CNX of 558.4, and a ratio to TSG101 of 3064.1.

TABLE 24

| Quantification of ratio of fusogen protein to total protein or other proteins of interest in fusosomes | | |
|---|---|---|
| Proteins | Raw MS Intensity | Fusogen:Protein(s) Ratio |
| VSV-G | $1.29 \times 10^8$ | N/A |
| Total Proteins | $9.46 \times 10^8$ | 0.136 |
| EGFP | $8.22 \times 10^5$ | 156.9 |
| CD63 | $4.43 \times 10^4$ | 2912.0 |
| ARRDC1 | $1.94 \times 10^5$ | 664.9 |
| GAPDH | $1.87 \times 10^6$ | 69.0 |
| CNX | $2.31 \times 10^5$ | 558.4 |
| TSG101 | $4.21 \times 10^4$ | 3064.1 |

Example 95: Quantification of Endogenous and Synthetic Protein Ratios in Fusosomes This example describes the quantification of an endogenous or synthetic protein cargo relative to total protein or other proteins of interest in fusosomes. Other proteins of interest may include, but are not limited to, VSV-G, CD63, ARRDC1, GAPDH, Calnexin (CNX), or TSG101. Fusosomes were prepared as described herein by the method of Examples 67 and 86. Protein quantification by mass spectrometry for fusosomes was performed as described herein in Example 35. The quantification of all proteins was calculated as described herein in Example 35, averaged over fusosome samples, and expressed as a fraction.

As shown in Table 25 below, the synthetic protein cargo was found to have a ratio to VSV-G of 6.37×10-3, a ratio to CD63 of 18.6, a ratio to ARRDC1 of 4.24, a ratio to GAPDH of 0.44, a ratio to CNX of 3.56, and a ratio to TSG101 of 19.52.

TABLE 25

| Quantification of endogenous and synthetic protein ratios in fusosomes | | |
|---|---|---|
| Proteins | Raw MS Intensity | Protein Cargo:Protein(s) Ratio |
| EGFP | $8.22 \times 10^5$ | N/A |
| Total Proteins | $9.46 \times 10^8$ | $8.69 \times 10^{-4}$ |
| VSV-G | $1.29 \times 10^8$ | $6.37 \times 10^{-3}$ |
| CD63 | $4.43 \times 10^4$ | 18.6 |
| ARRDC1 | $1.94 \times 10^5$ | 4.24 |
| GAPDH | $1.87 \times 10^6$ | 0.44 |
| CNX | $2.31 \times 10^5$ | 3.56 |
| TSG101 | $4.21 \times 10^4$ | 19.52 |

Example 96: Enriched Lipid Composition in Fusosomes

This Example describes quantification of the lipid composition of fusosomes, parental cells, and exosomes. It is contemplated that the lipid composition of fusosomes can be enriched and/or depleted for specific lipids relative to the cells from which they are derived. Lipid composition affects important biophysical parameters of fusosomes and cells, such as size, electrostatic interactions, and colloidal behavior.

The lipid composition was measured as described in Examples 67 and 86. Fusosomes were prepared as described herein by transient transfection of VSV-G and GFP in 10 cm dishes, followed by filtration and ultracentrifugation of the conditioned media 48 hours after transfection to obtain fusosomes. Transfected cells were harvested in parallel to the conditioned media and submitted for analysis. Exosomes were prepared as described herein for fusosomes with the exception that the parental cells were not transfected with VSV-G or GFP.

Figure 19A:
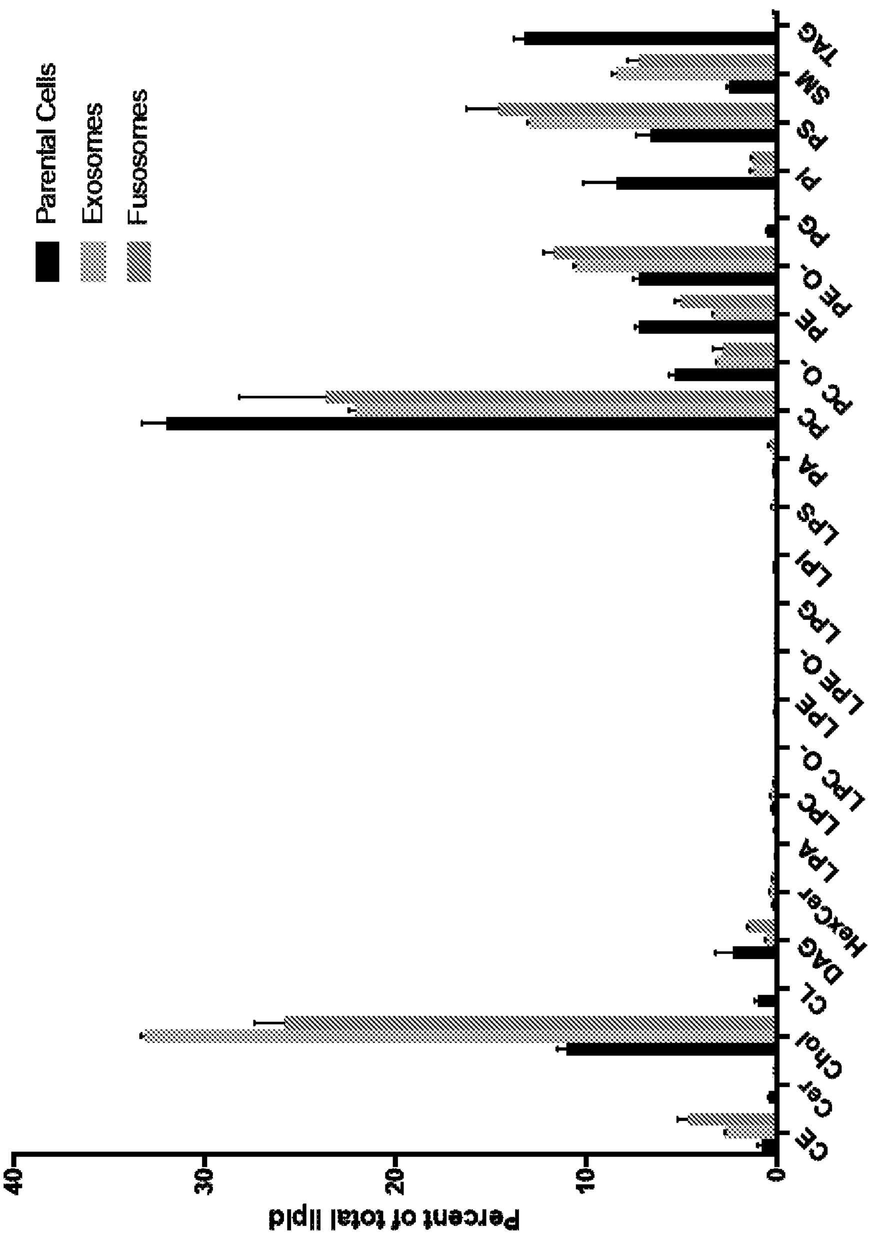
FIGS. 19A-19B are a series of graphs showing the proportion of lipid species as a percentage of total lipids in parental cells, exosomes, and fusosomes.
Figure 19B:
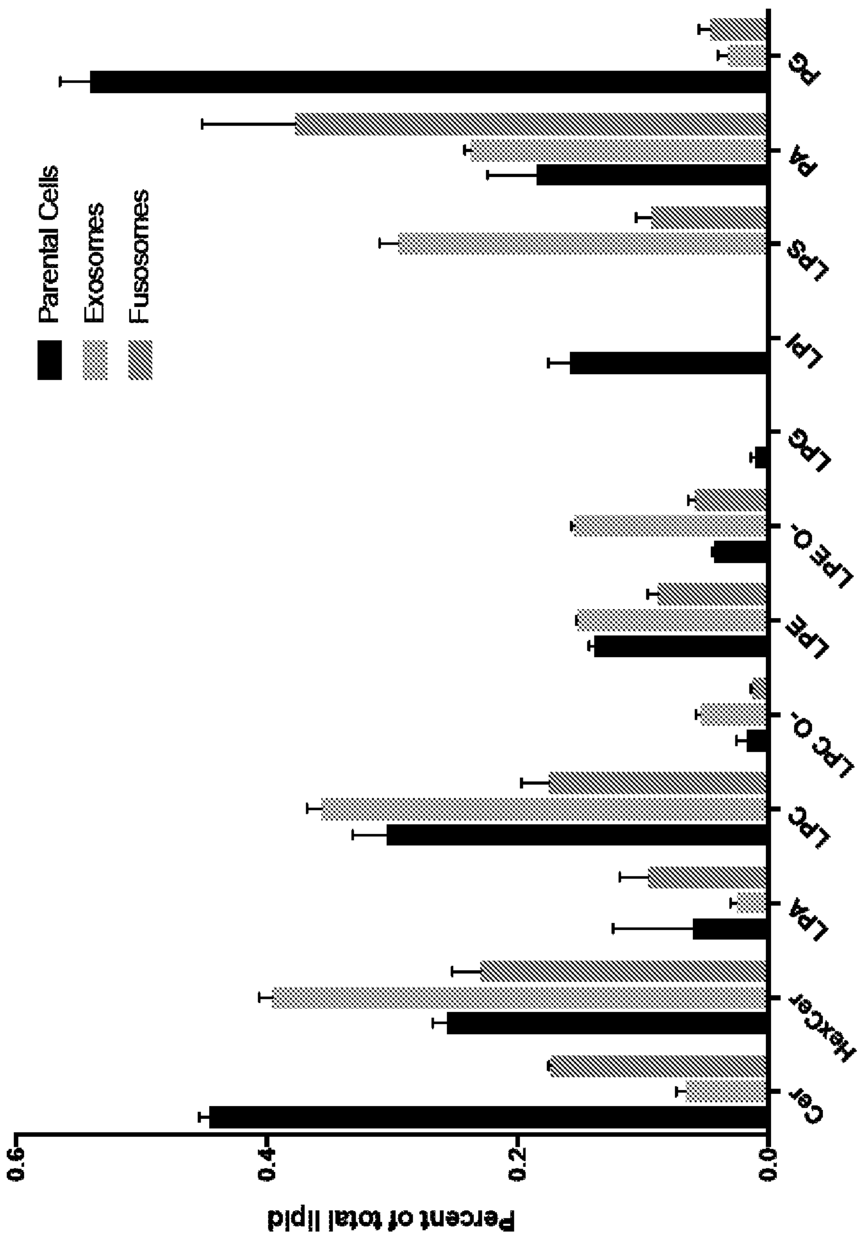

The lipid composition for fusosomes, exosomes, and parental cells is shown in FIGS. 19A-19B. Compared to parental cells, fusosomes were enriched for cholesteryl ester, free cholesterol, ether-linked lyso-phosphatidylethanolamine, lyso-phosphatidylserine, phosphatidate, ether-linked phosphatidylethanolamine, phosphatidylserine, and sphingomyelin. Compared to parental cells, fusosomes are depleted for ceramide, cardiolipin, lyso-phosphatidylcholine, lyso-phosphatidylethanolamine, lyso-phosphatidylglycerol, lyso-phosphatidylinositol, ether-linked phosphatidylcholine, phosphatidylethanolamine, phosphatidylglycerol, phosphatidylinositol, and triacylglycerol. Compared to exosomes, fusosomes were enriched for cholesteryl ester, ceramide, diacylglycerol, lyso-phosphatidate, and phosphatidylethanolamine, triacylglycerol. Compared to exosomes, fusosomes are depleted for free cholesterol, hexosyl ceramide, lyso-phosphatidylcholine, ether-linked lyso-phosphatidylcholine, lyso-phosphatidylethanolamine, ether-linked lyso-phosphatidylethanolamine, and lyso-phosphatidylserine,

Example 97: Measuring Compartment-Specific Proteomic Content of Fusosomes

This Example describes quantification of the proportion of proteins that are known to be derived from specific cellular compartments in fusosomes, fusosome parental cells, and exosomes.

Fusosomes and parental cells were prepared as described herein by the method of Examples 67 and 86. Exosomes were prepared as described herein for fusosomes by the method of Examples 67 and 86 with the exception that the parental cells were not transfected with VSV-G or GFP. Protein quantification by mass spectrometry for fusosomes and exosomes was performed as described herein in Example 35. The resulting protein quantification data was analyzed to determine protein levels and proportions of known exosomal,, endoplasmic reticulum, ribosome, nuclear, and mitochondrial proteins as annotated by Gene Ontology Cellular Compartment annotation terms (exosome: GO:0070062, endoplasmic reticulum: GO:0005783, ribosome: GO:0005840, GO:0022625, GO:0022626, GO:0022627, GO:0044391, GO:0042788, GO:0000313) with evidence code IDA (inferred by direct assay). The fraction of compartment-specific proteins relative to total protein in each sample was determined for fusosome samples, exosome samples, and parental cells.

Figure 20:
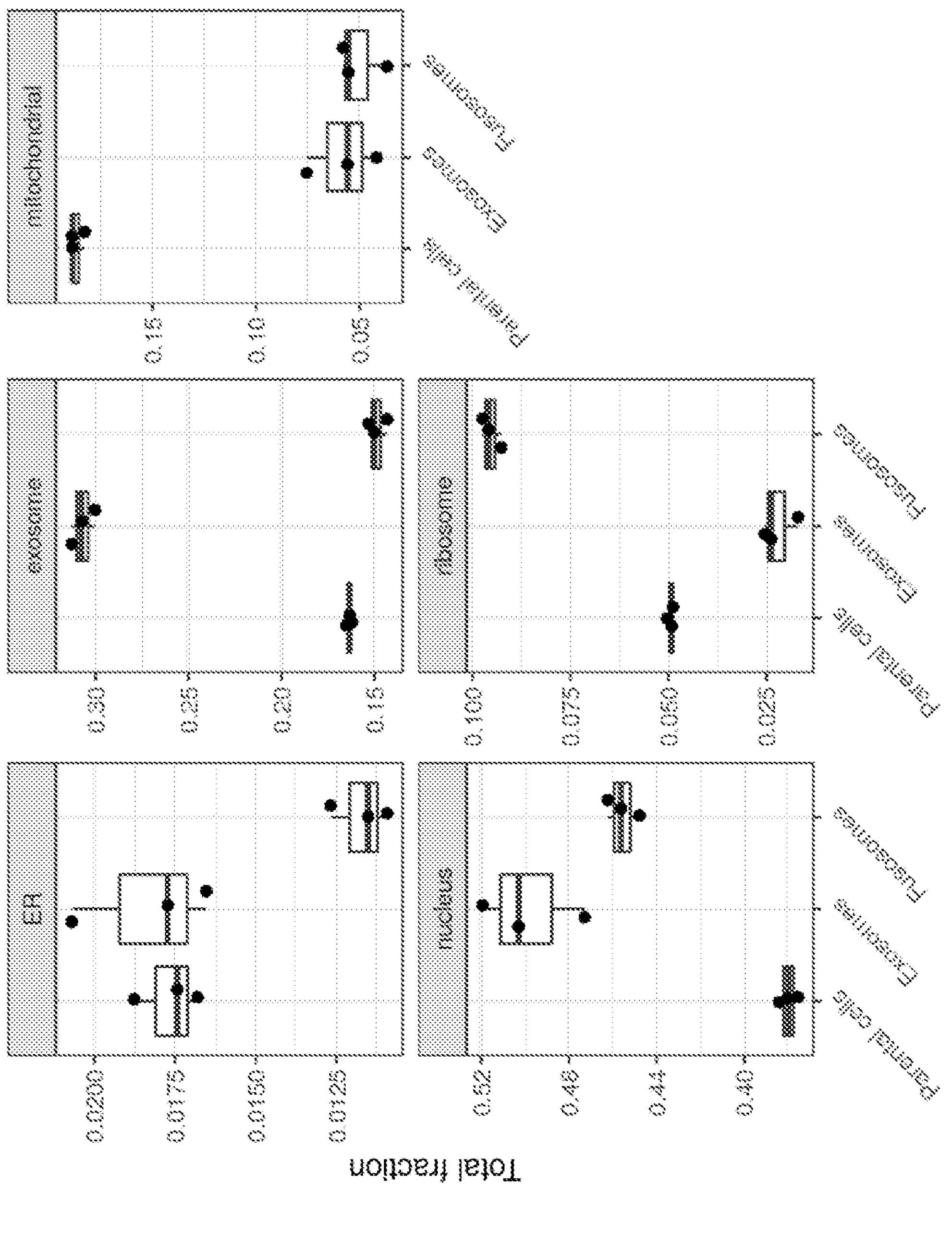
FIG. 20 is a series of graphs showing the protein content of parental cells, exosomes, and fusosomes with respect to proteins associated with specific compartments, as indicated.

As shown in FIG. 20, fusosomes were found to be depleted with endoplasmic reticulum protein compared to parental cells and exosomes. Fusosomes were also found to be depleted for exosomal protein compared to exosomes. Fusosomes were depleted for mitochondrial protein compared to parental cells. Fusosomes were enriched for nuclear protein compared to parental cells. Fusosomes were enriched for ribosomal proteins compared to parental cells and exosomes.

Example 98: Measuring TSG101 and ARRDC1 Content in Fusosomes

This Example describes quantification of the proportion of proteins that are known to be important in fusosome release from cells.

Fusosomes and parental cells were prepared as described herein by the method of Examples 67 and 86. Exosomes were prepared as described herein for fusosomes by the method of Examples 67 and 86 with the exception that the parental cells were not transfected with VSV-G or GFP. Protein quantification by mass spectrometry for fusosomes and exosomes was performed as described herein in Example 35. The resulting protein quantification data was analyzed to determine protein levels and proportions of the protein TSG101 and ARRDC1. Average log intensities per group were calculated by adding 1 to intensity values from mass spectrometry, transforming by log 10, and computing the mean across replicates. The percentage of total protein content of TSG101 or ARRDC1 in fusosomes relative to exosomes or parental cells was determined as the average log intensity of TSG101 or ARRDC1 for each sample, divided by the sum of intensities of all proteins in the same sample, averaged over replicates and expressed as a percent.

Figure 21:
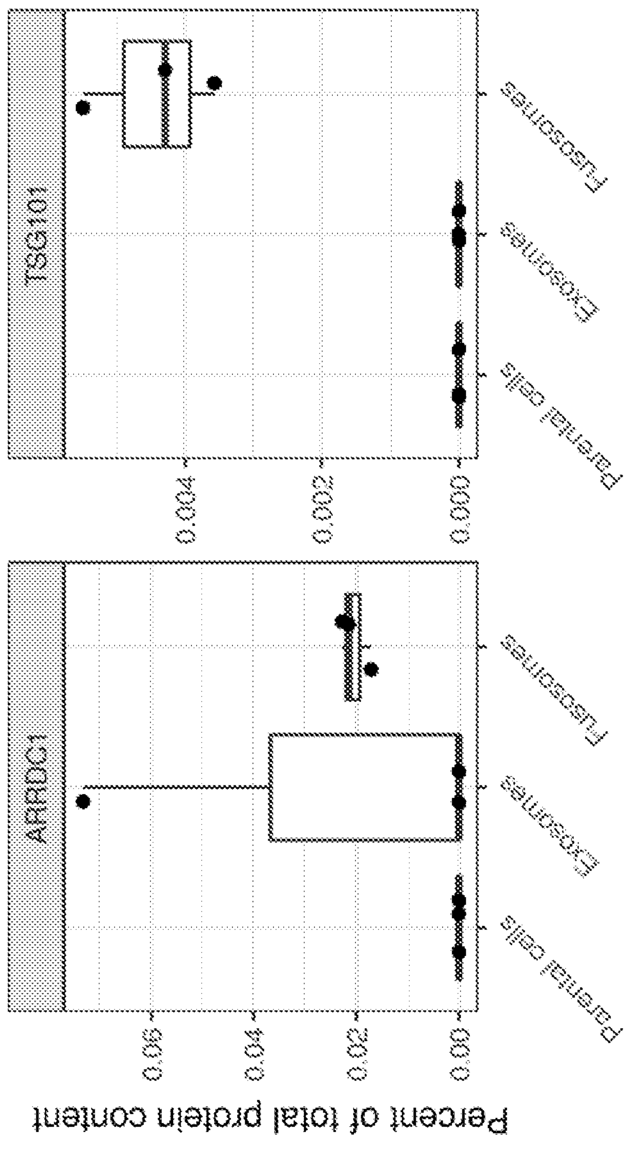
FIG. 21 is a series of graphs showing the level of ARRDC1 (left panel) or TSG101 (right panel) as a percentage of total protein content in parental cells, exosomes, and fusosomes.

As shown in FIG. 21, ARRDC1 was found to be present at greater levels as a percentage of total protein content in fusosomes than in parental cells or exosomes. The level of ARRDC1 as a percentage of total protein content was at least 0.02% in fusosomes. TSG101 was found to be present at greater levels as a percentage of total protein content in fusosomes than in parental cells or exosomes. The level of TSG101 as a percentage of total protein content was at least 0.004% in fusosomes.

Example 99: Measuring Serum Inactivation of Fusosomes after Multiple Administrations This Example describes quantification of serum inactivation of fusosomes using an in vitro delivery assay following multiple administrations of the fusosome. It is contemplated that a modified fusosome, e.g., modified by a method described herein, can have a reduced (e.g., reduced compared to administration of an unmodified fusosome) serum inactivation following multiple (e.g., more than one, e.g., 2 or more), administrations of the modified fusosome. In some instances, a fusosome described herein will not be inactivated by serum following multiple administrations.

A measure of immunogenicity for fusosomes is serum inactivation. In an embodiment, repeated injections of a fusosome can lead to the development of anti-fusosome antibodies, e.g., antibodies that recognize fusosomes. In an embodiment, antibodies that recognize fusosomes can bind in a manner that can limit fusosome activity or longevity and mediate complement degradation.

In this Example, serum inactivation is examined after one or more administrations of fusosomes. Fusosomes are produced by any one of the previous Examples. In this example, fusosomes are generated from: HEK293 cells modified with a lentiviral-mediated expression of HLA-G (hereafter HEK293-HLA-G), and HEK293 modified with a lentiviral-mediated expression of an empty vector (hereafter HEK293). In some embodiments, fusosomes are derived from cells that are expressing other immunoregulatory proteins.

Serum is drawn from the different cohorts: mice injected systemically and/or locally with 1, 2, 3, 5, 10 injections of vehicle (Fusosome naïve group), HEK293-HLA-G fusosomes, or HEK293 fusosomes. Sera are collected from mice by collecting fresh whole blood and allowing it to clot completely for several hours. Clots are pelleted by centrifugation and the serum supernatants are removed. A negative control is heat inactivated mouse serum. Negative control samples are heated at 56 degrees Celsius for 1 hour. Serum may be frozen in aliquots.

The fusosomes are tested for the dose at which 50% of cells in a recipient population receive the payload in the fusosomes. The fusosomes may be produced via any of the other examples described herein and may contain any of the payloads described herein. Many methods for assaying fusosome delivery of a payload to recipient cells are also described herein. In this particular example, the payload is Cre protein and the recipient cells are RPMI8226 cell which stably-expresses "LoxP-GFP-stop-LoxP-RFP" cassette under a CMV promoter, which upon recombination by Cre switches from GFP to RFP expression, indicating fusion and Cre, as a marker, of delivery. The identified dose at which 50% of the recipient cells are RFP positive is used for further experiments. In other embodiments, the identified dose at which 50% of the recipient cells receive the payload is used for further experiments.

To assess serum inactivation of fusosomes, fusosomes are diluted 1:5 into normal or heat-inactivated serum (or medium containing 10% heat-inactivated FBS as the no-serum control) and the mixture is incubated at 37 C for 1 h. Following the incubation, medium is added to the reaction for an additional 1:5 dilution and then serially diluted twice at a 1:10 ratio. Following this step, the fusosomes should be present at the previously identified dose at which 50% of the recipient cells have received the payload (e.g. are RFP positive). It is contemplated that the identified dose at which 50% of recipient cells receive the payload may be similar across fusosomes.

Fusosomes that have been exposed to serum are then incubated with recipient cells. The percent of cells which receive the payload, and thus are RFP positive, is calculated. The percent of cells which receive the payload may not be different between fusosome samples that have been incubated with serum and heat-inactivated serum from mice treated with HEK293-HLA-G fusosomes, indicating that there is not serum inactivation of fusosomes or an adaptive immune response. The percent of cells that receive the payload may not be different between fusosome samples that have been incubated from mice treated 1, 2, 3, 5 or 10 times with HEK293-HLA-G fusosomes, which would indicate that there was not serum inactivation of fusosomes or an adaptive immune response. In some instances, the percent of cells which receive the payload is not different between fusosome samples that have been incubated with serum from mice treated with vehicle and from mice treated with HEK293-HLA-G fusosomes, indicating that there is not serum inactivation of fusosomes or an adaptive immune response. In some instances, the percent of cells which receive the payload is less for fusosomes derived with HEK293 than for HEK293-HLA-G fusosomes, indicating that there is not serum inactivation of HEK293-HLA-G fusosomes or an adaptive immune response.

Example 100: Measuring Complement Targeting of Fusosomes

This Example describes quantification of complement activity against fusosomes using an in vitro assay. It is contemplated that a modified fusosome described herein can induce reduced complement activity compared to a corresponding unmodified fusosome.

In this Example, serum from a mouse is assessed for complement activity against a fusosome. The example measures the level of complement C3a, which is a central node in all complement pathways. Notably, the methods described herein may be equally applicable to humans, rats, monkeys with optimization to the protocol.

In this Example, fusosomes are produced by any one of the previous Examples. Fusosomes are generated from HEK293 cells modified with a lentiviral-mediated expression of a complement regulatory protein DAF (HEK293-DAF fusosomes) or HEK 293 cells not expressing a complementary regulatory protein (HEK293 fusosomes). Other complement regulatory proteins may also be used, such as proteins that bind decay-accelerating factor (DAF, CD55), e.g. factor H (FH)-like protein-1 (FHL-1), e.g. C4b-binding protein (C4BP), e.g. complement receptor 1 (CD35), e.g. Membrane cofactor protein (MCP, CD46), eg. PROFECTIN™ (CD59), e.g. proteins that inhibit the classical and alternative complement pathway CD/C5 convertase enzymes, e.g. proteins that regulate MAC assembly Serum is recovered from naïve mice, mice that are administered HEK293-DAF fusosomes, or mice that are administered HEK293 fusosomes. Sera are collected from mice by collecting fresh whole blood and allowing it to clot completely for several hours. Clots are pelleted by centrifugation and the serum supernatants are removed. A negative control is heat inactivated mouse serum. Negative control samples are heated at 56 degrees Celsius for 1 hour. Serum may be frozen in aliquots.

The different fusosomes are tested for the dose at which 50% of cells in a recipient population receive the payload in the fusosomes. The fusosomes may be produced via any of the other examples described herein and may contain any of the payloads described herein. Many methods for assaying fusosome delivery of a payload to recipient cells are also described herein. In this particular example, the payload is Cre protein and the recipient cells are RPMI8226 cell which stably-expresses "LoxP-GFP-stop-LoxP-RFP" cassette under a CMV promoter, which upon recombination by Cre switches from GFP to RFP expression, indicating fusion and Cre, as a marker, of delivery. The identified dose at which 50% of the recipient cells are RFP positive is used for further experiments. In other embodiments, the identified dose at which 50% of the recipient cells receive the payload is used for further experiments. In preferred embodiments, the identified dose at which 50% of recipient cells receive the payload is similar across fusosomes.

Two-fold dilutions of the fusosomes starting at the dose of fusosomes at which 50% of the recipient cells receive the payload in phosphate-buffered saline (PBS, pH 7.4) are mixed with a 1:10 dilution of the sera from mice treated with the same fusosomes or naïve mice (assay volume, 20 μl) and incubated for 1 h at 37° C. The samples are further diluted 1:500 and used in an enzyme-linked immunosorbent assay (ELISA) specific for C3a. The ELISA is mouse complement C3a ELISA Kit product LS-F4210 sold by LifeSpan BioSciences Inc, which measures the concentration of C3a in a sample. The dose of fusosomes at which 200 μg/ml of C3a is present is compared across sera isolated from mice.

In some instances, the dose of fusosomes at which 200 μg/ml of C3a is present is greater for HEK293-DAF fusosomes incubated with HEK-293 DAF mouse sera than for HEK293 fusosomes incubated with HEK293 mouse sera, indicating that complement activity targeting fusosomes is greater in mice treated with HEK293 fusosomes than HEK293-DAF fusosomes. In some instances, the dose of fusosomes at which 200 μg/ml of C3a is present is greater for HEK293-DAF fusosomes incubated with naive mouse sera than for HEK293 fusosomes incubated with naive mouse sera, indicating that complement activity targeting fusosomes is greater in mice treated with HEK293 fusosomes than HEK293-DAF fusosomes.

SEQUENCE LISTING (134 sequences)

SEQ ID NO: 1 - protein, 589 aa, Human respiratory syncytial virus
  MISC_FEATURE: fusion glycoprotein
MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 2 - protein, 553 aa, Newcastle disease virus
  MISC_FEATURE: fusion protein
MDPKPSTSYLHAFPLIFVAISLVFMAGRASALDGRPLAAAGIVVTGDKAVNIYTSSQTGTIIIKLLPNMPKDKEQCAKSPLDAYNRTLTTLLAPLGDSIRRIQESVTTSGGERQERLVGAIIGGVALGVATAAQITAASALIQANQNAANILKLKESIAATNEAVHEVTSGLSQLAVAVGKMQQFVNDQFNKTAQEIDCIKITQQVGVELNLYLTELTTVFGPQITSPALTQLTIQALYNLAGGNMDYMLTKLGVGNNQLSSLISSGLISGNPILYDSQTQLLGIQVTLPSVGNLNNMRATYLETLSVSTNKGFASALVPKVVTQVGSVIEELDTSYCIETDLDLYCTRIVTFPMSPGIFSCLGGNTSACMYSKTEGALTTPYMTLKGSVIANCKMTTCRCADPPGIISQNYGEAVSLIDKKVCNILTLDGITLRLSGEFDATYQKNISIQDSQVVITGNLDISTELGNVNNSISNALDKLEESNSKLDKVNVRLTSTSALITYIVLTTIALICGIVSLVLACYIMYKQKAQQKTLLWLGNNTLDQMRATTKM

SEQ ID NO: 3 - protein, 553 aa, Measles virus strain AIK-C
  MISC_FEATURE: fusion protein
MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGYTKSCARTLVSGSFGNRFILSQGNLIANCASILCKCYTTGTIINQDPDKILTYIAADNCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL

SEQ ID NO: 4 - protein, 539 aa, Human metapneumovirus
  MISC_FEATURE: fusion glycoprotein precursor
MSWKVVIIFSLLITPQHGLKESYLEESCSTITEGYLSVLRTGWYTNVFTLEVGDVENLTCSDGPSLIKTELDLTKSALRELKTVSADQLAREEQIEKPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 5 - protein, 540 aa, Bovine parainfluenza virus 3
  MISC_FEATURE: fusion protein
MIIIVITMILSLTPSSLCQIDITKLQSVGVLVNSPKGIKISQNFETRYLILSLIPKIEDSHSCGNQQIDQYKKLLDRLIIPLYDGLKLQKDVIVVNHESHNNTNLRTKRFFGEIIGTIAIGIATSAQITAAVALVEAKQARSDIDKLKEAIKDTNKAVQSIQSSVGNLIVAVKSVQDYVNNEIVPSITRLGCEAAGLQLGIALTQHYSELTNIFGDNIGTLGEKGVKLQGIASLYRTNITEVFTTSTVDQYDIYDLLFTESIKMRVIDVDLSDYSITLQVRLPLLTKVSNTQIYKVDSISYNIQGKEWYIPLPHHIMTKGAFLGGADIKECIESFSNYICPSDPGFILNHEMENCLSGNITQCPKTIVTSDIVPRYAFVDGGVIANCIPTTCTCNGIDNRINQSPDQGIKIITYKECQIVGINGMLFKTNQEGTLAKYTFDNIKLNNSVALNPIDISLELNKAKSDLEESKRWIEKSNQKLDSIGSWHQSSVTIIIIIVMIVVLLIINAIIIMIMIRYLRDRNRHLNNKDSEPYVLTNRQ

SEQ ID NO: 6 - protein, 538 aa, Mumps virus
  MISC_FEATURE: fusion protein
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRY

SEQ ID NO: 7 - protein, 671 aa, Canine distemper virus
  MISC_FEATURE: fusion protein
MNPHEQTIPMHEKIPKRSKTQTHTQQDLPQQHSTKSAESKTSRARHSITSAQRSTHYDPRTADWPDYYIMKRTRSCKQASYRSDNIPAHGDHDGIIHHTPESVSQGAKSRLKMGQSNAVKSGSQCTWLVLWCIGVASLFLCSKAQIHWNNLSTIGIIGTDSVHYKIMTRPSHQYLVIKLMPNVSLIDNCTKAELDEYEKLLSSILEPINQALTLMTKNVKPLQSVGSGRRQRRFAGVVLAGAALGVATAAQITAGIALHQSNLNAQAIQSLRTSLEQSNKAIEEIREATQETVIAVQGVQDYVNNELVPAMQHMSCELVGQRLGLKLLRYYTELLSIFGPSLRDPISAEISIQALSYALGGEIHKILEKLGYSGNDMIAILESRGIKTKITHVDLPGKFIILSVSYPTLSEVKGVIVHRLEAVSYNIGSQEWYTTVPRYVATNGYLISNFDESSCVFVSESAICSQNSLYPMSPLLQQCIRGDTSSCARTLVSGTMGNKFILSKGNIVANCASILCKCYSTSTIINQSPDKLLTFIASDTCPLVEIDGVTIQVGSRQYPDMVYESKVALGPAISLERLDVGTNLGNALKKLDDAKVLIDSSNQILETVRRSSFNFGSLLSVPILSCTALALLLLICCCKRRYQQTHKQNTKVDPTFKPDLTGTSRSYVRSL

SEQ ID NO: 8 - protein, 546 aa, Peste-des-petits-ruminants virus
  MISC_FEATURE: fusion protein
MTRVAILTFLFLFPNAVACQIHWGNLSKIGIVGTGSASYKVMTRPSHQTLVIKLMPNITAIDNCTKSEIAEYKRLLITVLKPVEDALSVITKNVRPIQTLTPGRRTRRFAGAVLAGVALGVATAAQITAGVALHQSLMNSQAIESLKTSLEKSNQAIEEIRLANKETILAVQGVQDYINNELVPSVHRMSCELVGHKLGLKLLRYYTEILSIFGPSLRDPIAAEISIQALSYALGGDINRILDKLGYSGGDFLAILESKGIKARVTYVDTRDYFIILSIAYPTLSEIKGVIVHKIEAITYNIGAQEWYTTIPKYVATQGYLISNFDETSCVFTPDGTVCSQNALYPMSPLLQECFQGSTKSCARTLVSGTISNRFILSKGNLIANCASVLCKCYTTETVISQDPDKLLTVVASDKCPVVEVDGVTIQVGSREYPDSVYLHKIDLGPAISLEKLDVGTNLGNAVTRLENAKELLDASDQILKTVKGVPFGGNMYIALAACIGVSLGLVTLICCCKGRCKNKEVPISKINPGLKPDLTGTSKSYVRSL

SEQ ID NO: 9 - protein, 546 aa, Hendra virus
  MISC_FEATURE: fusion protien
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 10 - protein, 565 aa, Sendai virus
  MISC_FEATURE: fusion protein
MATYIQRVQCISALLSVVLTTLVSCQIPRDRLSNIGVIVDEGKSLKIAGSHESRYIVLSLVPGIDLENGCGTAQVIQYKSLLNRLLIPLRDALDLQEALITVTNDTMTGADVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDNIIPKFAFVNGGVVANCIASTCTCGTGRRPISQDRSKGVVFLTHDNCGLIGVNGIELYANRKGHDATWGVQNLTVGPAIAIRPVDISLNLAAATDFLQDSRAELEKARKILSEVGRWYNSGATLITIIVVMIVVLVVIIVIVIVLYRLRRSMLMSNPAGRISRDTYTLEPKIRHMYTNGGFDAMTEKR

SEQ ID NO: 11 - protein, 555 aa, Human parainfluenza virus 1 strain Washington/1964
  MISC_FEATURE: F Glycoprotein
MQKSEILFLVYSSLLLSSSLCQIPVEKLSNVGVIINEGKLLKIAGSYESRYIVLSLVPSIDLQDGCGTTQIIQYKNLLNRLLIPLKDALDLQESLITITNDTTVTNDNPQTRFFGAVIGTIALGVATAAQITAGIALAEAREARKDIALIKDSIVKTHNSVELIQRGIGEQIIALKTLQDFVNDEIRPAIGELRCETTALKLGIKLTQHYSELATAFSSNLGTIGEKSLTLQALSSLYSANITEILSTTKKDKSDIYDIIYTEQVKGTVIDVDLEKYMVTLLVKIPILSEIPGVLIYRASSISYNIEGEEWHVAIPNYIINKASSLGGADVTNCIESKLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPAVSIRPVDISLNLASATNFLEESKTELMKARAIISAVGGWHNTESTQIIMIIIVCILIIIICGILYYLYRVRRLLVMINSTHNSPVNAYTLESRMRNPYMGNNSN

SEQ ID NO: 12 - protein, 543 aa, Feline morbillivirus
  MISC_FEATURE: fusion protein
MGKIRVIIISSLLLSNITTAQVGWDNLTSIGVISTKQYDYKITTLNTNQLMVIKMVPNISSIINCTKPELMKYRELVLGVIRPINESLELMNSYINMRAGSERFIGAVIAGVALGVATAAQITSGIALHNSIMNKRQIQELRKALSTTNKAIDEIRIAGERTLIAVQGVQDYINNIIIPMQDKLQCDILSSQLAIALLRYYTNILTVFGPSIRDPVTSIISIQALSQAFNGNLQALLDGLGYTGRDLRDLLESRSITGQIIHADMTDLFLVLRINYPSITEMQGVTIYELNSITYHIGPEEWYTIMPNFIAVQGFLTSNFDERKCSITKSSILCQQNSIYPMSTEMQRCIKGEIRFCPRSKAVGTLVNRFILTKGNLMANCLGVICRCYSSGQIITQDPSKLITIISQEECKEVGVDGIRIMVGPRKLPDVIFNARLEVGVPISLSKLDVGTDLAIASAKLNNSKALLEQSDKILDSMSKLDSINSRITGLILAIMAIFIITVTIIWIIYKRCRNKDNKFSTSIEPLYIPPSYNSPHSVVKSI

SEQ ID NO: 13 - protein, 534 aa, Avian paramyxovirus 2
  MISC_FEATURE: fusion protein
MIAALFISLFATCGALDNSVLAPVGIASAQEWQLAAYTNTLSGTIAVRFVPVLPGNLSTCAQATLAEYNKTVTNILGPLKENLETLLSEPTKTAARFVGAIIGTVALGVATSAQITAAVALNQAQENARNIWRLKESIRKTNEAVLELKDGLASTAIALDKVQKFINEDIIPQIKEIDCQVVANKLGVYLSLYLTELTTIFGAQITNPALTPLSYQALYNLCGGDMGKLTELIGVKAKDINSLYEANLITGQVIGYDSESQIILIQVSYPSVSEVTGVRATELVTVSVTTPKGEGRAIAPKYVAQSRVVTEELDTSTCRFSKTTLYCRSIITRPLPPLIANCLNGLYQDCQYTTEIGALSSRFITVNGGIIANCRATICKCVNPPKIIVQSDASSLTVIDSAICKDVVLDNVQLRLEGKLSAQYFTNITIDLSQITTSGSLDISSEIGSINNTVNKVEELIAESNAWLQAVNPHLVNNTSIIVLCVLAAIFVVWLVALTGCLAYYIKKSSATRMVGIGSSPAGNPYVAQSATKM

SEQ ID NO: 14 - protein, 555 aa, Avian paramyxovirus 6
  MISC_FEATURE: fusion protein
MGARLGPLAMAPGRYVIIFNLILLHRVVSLDNSRLLQQGIMSATEREIKVYTNSITGSIAVRLIPNLPQEVLKCSAGQIKSYNDTLNRIFTPIKANLERLLATPSMLEDNQNPAPEPRLIGAIIGTAALGLATAAQVTAALALNQAQDNAKAILNLKESITKTNEAVLELKDATGQIAIALDKTQRFINDNILPAINNLTCEVAGAKVGVELSLYLTELSTVFGSQITNPALSTLSIQALMSLCGNDFNYLLNLMGAKHSDLGALYEANLINGRIIQYDQASQIMVIQVSVPSISSISGLRLTELFTLSIETPVGEGKAVVPQFVVESGQLLEEIDTQACTLTDTTAYCTIVRTKPLPELVAQCLRGDESRCQYTTGIGMLESRFGVFDGLVIANCKATICRCLAPEMIITQNKGLPLTVISQETCKRILIDGVTLQIEAQVSGSYSRNITVGNSQIAPSGPLDISSELGKVNQSLSNVEDLIDQSNQLLNRVNPNIVNNTAIIVTIVLLVLLVLWCLALTISILYVSKHAVRMIKTVPNPYVMQAKSPGSATQF

SEQ ID NO: 15 - protein, 545 aa, Fer-de-Lance paramyxovirus
  MISC_FEATURE: fusion protein F
MTRITILQIILTLTLPVMCQVSFDNLEQVGVMFDKPKFLKITGPASTATMIIKLIPTLGTMESCGTSAVNEYKKTLDTILVPLRDTINKLSTDITVVEGTSNISNKREKRFVGIAIAVGAVALATSAQITAGIALSNTIKNAEAIESIKSSIQASNQAIQKVIDAQGRTVTVINGIQDHINSVINPALNQLGCDVAKNTLAISLTQYFSKLSLLFGPNLRNPVEQPLSVQAIAGLMDGDINAVVSQLGYTQSDLLDLLSTESIVGTVTAIDMVNYMIQIEMSFPQYITIPDTKVLEGHKITFNDKGSEWQTQVPSTIAVRDILIAGVDPDGCSITSTSYICKNDPTYAMSEVLTNCFRGNTQECPRARITSTFATRFAIARSTVIANCVAAVCLCGDPGIPVVQKAEVTLTAMTLDQCSLITVDGLQIKPSKSIANVTANFGNITLGPVVSVGDLDLSAELTKVQSDLKEAQDKLDESNAILQGINNKILTAPTSIALIVVSVVVILLIIGMISWLVWLTKAVRRSNTRSERVTPSAYNNLGFIK

SEQ ID NO: 16 - protein, 566 aa, Avian paramyxovirus 4
  MISC_FEATURE: fusion protein
MRLSRTILTLILGTLTGYLMGAHSTNVNEGPKSEGIRGDLIPGAGIFVTQVRQLQIYQQSGYHDLVIRLLPLLPAELNDCQREVVTEYNNTVSQLLQPIKTNLDTLLADGGTRDADIQPRFIGAIIATGALAVATVAEVTAAQALSQSKTNAQNILKLRDSIQATNQAVFEISQGLEATATVLSKLQTELNENIIPSLNNLSCAAMGNRLGVSLSLYLTLMTTLFGDQITNPVLTPISYSTLSAMAGGHIGPVMSKILAGSVTSQLGAEQLIASGLIQSQVVGYDSQYQLLVIRVNLVRIQEVQNTRVVSLRTLAVNRDGGLYRAQVPPEVVERSGIAERFYADDCVLTTTDYICSSIRSSRLNPELVKCLSGALDSCTFERESALLSTPFFVYNKAVVANCKAATCRCNKPPSIIAQYSASALVTITTDTCADLEIEGYRFNIQTESNSWVAPNFTVSTSQIVSVDPIDISSDIAKINSSIEAAREQLELSNQILSRINPRIVNDESLIAIIVTIVVLSLLVIGLIVVLGVMYKNLKKVQRAQAAMMMQQMSSSQPVTTKLGTPF

SEQ ID NO: 17 - protein, 551 aa, Human parainfluenza virus 2
  MISC_FEATURE: fusion protein
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDRINGAIVNGITSASCRAHDALIGSILNLYLTELTTIFHNQITNPALTPLSIQALRILLGSTLPIVIESKLNTNFNTAELLSSGLLTGQIISISPMYMQMLIQINVPTFIMQPGAKVIDLIAISANHKLQEVVVQVPNRILEYANELQNYPANDCVVTPNSVFCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 18 - protein, 541 aa, Porcine rubulavirus
  MISC_FEATURE: fusion protein
MPQQQVAHTCVMLWGIISTVSGINTEALSQYGVVVTNVRQLTYYTQAGSTYLAVRLLPSLASPDQSCALHSIINYNATLQAILSPIAENLNLISTALREQHRKKRFAGVAIGLTALGVATAAQATAAVALVRANKNAEKVEQLSQALGETNAAISDLIDATKNLGFAVQAIQNQINTAILPQIHNLSCQVIDAQLGNILSLYLTELTTVFQPQLTNPALSPLTIQALRAVLGTTLPALLSEKLKSNIPLGDLMSSGLLKGQLVGLNLQNMLMIIELYIPTLSTHSTAKVLDLVTISSHVNGREVEIQVPNRVLELGSEVLGYGGSECALTMSHILCPFNDARVLSTDMKYCLQGNITHCIFSPVVGSFLRRFALVNGVVIANCADMSCVCFDPQEIIYQNFQEPTTVIDIKKCGKVQLDTLTFTISTFANRTYGPPAYVPPDNIIQSEPLDISGNLIAVNNSLSSALNHLATSEILRNEQIWTSSLGISTIVALVIIGILIICLVVTWAALWALLKEVRGLNSAVNSQLSSYVMGDKFIRY

SEQ ID NO: 19 - protein, 551 aa, Parainfluenza virus 5
  MISC_FEATURE: fusion protein
MGTRIQFLMVSCLLAGTGSLDPAALMQIGVIPTNVRQLMYYTEASSAFIVVKLMPTIDSPISGCNITSISSYNATMTKLLQPIGENLETIRYQLIPTRRRRRFVGVVIGLAALGVATAAQVTAAVALVKANKNAAAILNLKNAIQKTNAAVADVVQATQSLGTAVQAVQDHINSVVSPAITAANCKAQDAIIGSILNLYLTELTTIFHNQITNPALSPITIQALRILLGSTLPTVVRKSFNTQISAAELLSSGLLTGQIVGLDLTYMQMVIKIELPTLTVQPATQIIDLVTISAFINNREVMAQLPTRIIVTGSLIQAYPASQCTITPNTVYCRYNDAQVLSDDTMACLQGNLTRCTFSPVVGSFLTRFVLFDGIVYANCRSMLCKCMQPAAVILQPSSSPVTVIDMHKCVSLQLDNLRFTITQLANITYNSTIKLETSQILPIDPLDISQNLAAVNKSLSDALQHLAQSDTYLSAITSATTTSVLSIIAICLGSLGLILIILISVVVWKLLTIVAANRNRMENFVYHNSAFHHSRSDLSEKNQPATLGTR

SEQ ID NO: 20 - protein, 537 aa, Murine pneumonia virus
  MISC_FEATURE: fusion glycoprotein precursor
MIPGRIFLVLLVIFNTKPIHPNTLTEKFYESTCSVETAGYKSALRTGWHMTVMSIKLSQINIESCKSSNSLLAHELAIYSSAVDELRTLSSNALKSKRKKRFLGLILGLGAAVTAGVALAKTVQLESEIALIRDAVRNTNEAVVSLTNGMSVLAKVVDDLKNFISKELLPKINRVSCDVHDITAVIRFQQLNKRLLEVSREFSSNAGLTHTVSSFMLTDRELTSIVGGMAVSAGQKEIMLSSKAIMRRNGLAILSSVNADTLVYVIQLPLFGVMDTDCWVIRSSIDCHNIADKYACLARADNGWYCHNAGSLSYFPSPTDCEIHNGYAFCDTLKSLTVPVTSRECNSNMYTTNYDCKISTSKTYVSTAVLTTMGCLVSCYGHNSCTVINNDKGIIRTLPDGCHYISNKGVDRVQVGNTVYYLSKEVGKSIVVRGEPLVLKYDPLSFPDDKFDVAIRDVEHSINQTRTFLKASDQLLDLSENRENKNLNKSYILTTLLFVVMLIIIMAVIGFILYKVLKMIRDNKLKSKSTPGLTVLS

SEQ ID NO: 21 - protein, 543 aa, Human parainfluenza virus 4a
  MISC_FEATURE: fusion protein
MGVKGLSLIMIGLLISPITNLDITHLMNLGTVPTAIRSLVYYTYTKPSYLTVDLIPNLKNLDQNCNYSSLNYYNKTALSLIQPIADNINRLTKPITSSEIQSRFFGAVIGTIALGVATAAQVTAAIGLAKAQENAKLILTLKKAATETNEAVRDLANSNKIVVKMISAIQNQINTIIQPAIDQINCQIKDLQVANILNLYLTEITTVFHNQLTNPALESISIQALKSLLGPTLPEVLSKLDLNNISAASVMASGLIKGQIIAVDIPTMTLVLMVQIPSISPLRQAKIIDLTSITIHTNSQEVQAVVPARFLEIGSEILGFDGSVCQITKDTIFCPYNDAYELPIQQKRCLQGQTRDCVFTPVAGTFPRRFLTTYGTIVANCRDLVCSCLRPPQIIYQPDENPVTIIDKDLCTTLTLDSITIEIQKSINSTFRREVVLESTQVRSLTPLDLSTDLNQYNQLLKSAEDHIQRSTDYLNSINPSIVNNNAIIILIILCILLILTVTICIIWLKYLTKEVKNVARNQRLNRDADLFYKIPSQIPVPR

SEQ ID NO: 22 - protein, 538 aa, Tioman virus
  MISC_FEATURE: fusion protein
MRIALTAVIVSIHFDLAFPMNKNSLLSVGLVHKSVKNLYFYSQGSPSYIVVKLVPTLGNVPGNCTLNSLVRYKSTVSSLLSPLAENLEYLQKTLTVSRGGRRRRFAGVAIGLAALGVAAAAQATAAVALVEARQNAAQIQSLSEAIQNTNLAVNELKTAIGASATAIQAIQTQINEVINPAINRLSCEILDAQLASMLNLYLIHLTTVFQNQLTNPALTPLSIQSLQSLLQGTSSVLTNITSSSKLALNDALVTGLITGQVVGLNMTSLQIVIAAYVPSVAKLSNAVVHNFIRITTSVNGTEVIIQSPTIIMEQNEVMYDLKTGHCTESDLNIYCPYVDAQLLSPGMTNCINGRLNDCTFSKVVGSFPTRFAAVEGAILANCKYLQCNCLTPPYIITPLNGEMISMIDLSKCQRLDLGTIVFDINNPVNVTFNGNYRADVGQMIVTNPLDISAELNQINTSLSNAQGFLSKSDAWLHVSQWVTNSGTIFIILIIGLIVGIVYMIINTYVVVQIIKEINRMRTSDRAHLLKGSISSIST

SEQ ID NO: 23 - protein, 543 aa, Avian paramyxovirus 8
  MISC_FEATURE: fusion protein
MGQISVYLINSVLLLLVYPVNSIDNTLIAPIGVASANEWQLAAYTTSLSGTIAVRFLPVLPDNMTTCLRETITTYNNTVNNILGPLKSNLDALLSSETYPQTRLIGAVIGSIALGVATSAQITAAVALKQAQDNARNILALKEALSKTNEAVKELSSGLQQTAIALGKIQSFVNEEILPSINQLSCEVTANKLGVYLSLYLTELTTIFGAQLTNPALTSLSYQALYNLCGGNMAMLTQKIGIKQQDVNSLYEAGLITGQVIGYDSQYQLLVIQVNYPSISEVTGVRATELVTVSVTTDKGEGKAIVPQFVAESRVTIEELDVASCKFSSTTLYCRQVNTRALPPLVASCLRGNYDDCQYTTEIGALSSRYITLDGGVLVNCKSIVCRCLNPSKIISQNTNAAVTYVDATICKTIQLDDIQLQLEGSLSSVYARNISIEISQVTTSGSLDISSEIGNINNTVNRVEDLIHQSEEWLAKVNPHIVNNTTLIVLCVLSALAVIWLAVLTAIIIYLRTKLKTISALAVTNTIQSNPYVNQTKRESKF

SEQ ID NO: 24 - protein, 546 aa, Tailam virus
  MISC_FEATURE: fusion protein
MKLSVVYTTLLVSTFYSDLARSQLALSELTKIGVIPGRSYDLKISTQASYQYMVVKLIPNLTGLNNCTNGTIEAYKKMLNRLLSPIDAALRKMKDAVNDKPPESVGNVKFWGAVIGGVALGVATSAQITAGVALHNSIQNANAILALKDSIRQSNKAIQELQTAMSTTVVVLNALQDQINNQLVPAINSLGCQVVANTLGLKLNQYFSEISLVFGPNLRDPTSETLSIQALSRAFNGDFDSMLSKLKYDDSDFLDLLESDSIRGRIIDVSLSDYLITIQIEYPALLSIKDAVIQTFNLISYNTRGTEWISIFPKQLLVRGTYISNIDISQCVIAATSIICKSDTSTPISSATWSCATGNITNCARTRVVNAHVPRFALYGGVVFANCAPVVCKCQDPLYSINQEPKVTNVMVDVDACKEMYLDGLYITLGKTQISRAMYAEDVSLGGPISVDPIDLGNEINSINSAINRSEEHLNHANELLDKVNPRIVNVKTFGVMIGLLVLVVLWCVITLVWLICLTKQLARTAYAGSMGSRASTVNSLSGFVG

SEQ ID NO: 25 - protein, 557 aa, Porcine parainfluenza virus 1
  MISC_FEATURE: fusion protein
MQVTTLRPAIILSIALLVTGQVPRDKLANLGIIIKDSKALKIAGSYENRYIVLSLVPTIDNVNGCGSIQIAKYKEMLERLLIPIKDALDLQESLIVIDNETVNNNYSPQYRFVGAIIGTIALGVATAAQVTAGVALMEAREAKRDISMLKEAIEKTQNSIEKLQNSAGEQILALKMLQDYVNGEIKPAIEELGCETAALKLGIALTQHYTELTNAFGSNLGSIGEKSLTLQALSSLYKTNITNILTATNLGKTDIYDIIYAEQVKGRVIDVDLKRYMVTISVKIPILSEIPGVLIYEVSSISYNIDGAEWYAAVPDHILSKSAYIGGADISDCIESRLTYICPQDPAQIIADNQQQCFFGHLDKCPITKVIDNLVPKFAFINGGVVANCIASTCTCGEERIQVSQDRNKGVTFLTHNNCGLIGINGIEFHANKKGSDATWNVSPIGVGPAVSLRPVDISLQIVAATNFLNSSRKDLMKAKEILNQVGNLKDLTTITIINIVIIIILLICVIGLGILYHQLRSALGMRDKMSVLNNSSYSLEPRTAQVQVIKPTSFMG

SEQ ID NO: 26 - protein, 538 aa, Avian metapneumovirus
  MISC_FEATURE: F protein
MDVRICLLLFLISNPSSCIQETYNEESCSTVTRGYKSVLRTGWYTNVFNLEIGNVENITCNDGPSLIDTELVLTKNALRELKTVSADQVAKESRLSSPRRRRFVLGAIALGVATAAAVTAGVALAKTIRLEGEVKAIKNALRNTNEAVSTLGNGVRVLATAVNDLKEFISKKLTPAINQNKCNIADIKMAISFGQNNRRFLNVVRQFSDSAGITSAVSLDLMTDDELVRAINRMPTSSGQISLMLNNRAMVRRKGFGILIGVYDGTVVYMVQLPIFGVIETPCWRVVAAPLCRKRRGNYACILREDQGWYCTNAGSTAYYPNKDDCEVRDDYVFCDTAAGINVALEVDQCNYNISTSKYPCKVSTGRHPVSMVALTPLGGLVSCYESVSCSIGSNKVGIIKQLGKGCTHIPNNEADTITIDNTVYQLSKVVGEQRTIKGAPVVNNFNPILFPVDQFNVALDQVFESIDRSQDLIDKSNDLLGADAKSKAGIAIAIVVLVILGIFFLLAVIYYCSRVRKTKPKHDYPATTGHSSMAYVS

SEQ ID NO: 27 - protein, 545 aa, Avian paramyxovirus 13 goose/Kazakhstan/5751/2013
  MISC_FEATURE: fusion protein
MARFSWEIFRLSTILLIAQTCQGSIDGRLTLAAGIVPVGDRPISIYTSSQTGIIVVKLIPNLPDNKKDCAKQSLQSYNETLSRILTPLATAMSAIRGNSTTQVRENRLVGAIIGSVALGVATAAQITAATALIQANQNAANIARLANSIAKTNEAVTDLTEGLGTLAIGVGKLQDYVNEQFNNTAVAIDCLTLESRLGIQLSLYLTELMGVFGNQLTSPALTPITIQALYNLAGGNLNALLSRLGASETQLGSLINSGLIKGMPIMYDDANKLLAVQVELPSIGKLNGARSTLLETLAVDTTRGPSSPIIPSAVIEIGGAMEELDLSPCITTDLDMFCTKIISYPLSQSTLSCLNGNLSDCVFSRSEGVLSTPYMTIKGKIVANCKQVICRCMDPPQILSQNYGEALLLIDENTCRSLELSGVILKLAGTYESEYTRNLTVDPSQVIITGPLDISAELSKVNQSIDSAKENIAESNKFLSQVNVKLLSSSAMITYIVATVVCLIIAITGCVIGIYTLTKLKSQQKTLLWLGNNAEMHGSRSKTSF

SEQ ID NO: 28 - protein, 554 aa, Menangle virus
  MISC_FEATURE: fusion protein
MMPRVLGMIVLYLTHSQILCINRNTLYQIGLIHRSVKKVNFYSQGSPSYIVVKLVPTLAAIPPNCSIKSLQRYKETVTSLVQPISDNLGYLQDKLVTGQSRRRRRFAGVAIGLAALGVAAAAQATAAVALVETRENAGKIQALSESIQNTNQAVHSLKTALGFSATAIQAIQNQVNEVINPAINKLSCEVLDSQLASMLNLYLIHLTTVFQTQLTNPALTPLSIQALTSVLQGTSGVLMNSTNSTLTQPIDLLATGLITGQIISVNMTSLQLIIATFMPSIAELPNAVLHSFFRITTSVNLTEVMIQSPEFIMEQNGVFYDFNTAHCQLGDNNVYCPYIDAARLSSMMTNCINGNLGECVFSRVIGSFPSRFVSLNGAILANCKFMRCNCLSPEKIITPLDGEMISLIDLRVCQKLTLGTITFEISQPVNVSFQGGFVANAGQIIVTNPFDISAELGQINNSLNDAQGFLDQSNNWLKVSGWINNSGSLFIAGIVVIGLIVLCIVIIIYINVQIIREVNRLRSFIYRDYVLDHDKAPYSPESSSPHRKSLKTVS

SEQ ID NO: 29 - protein, 544 aa, Avian paramyxovirus 5
  MISC_FEATURE: fusion protein
MLQLPLTILLSILSAHQSLCLDNSKLIHAGIMSTTEREVNVYAQSITGSIVVRLIPNIPSNHKSCATSQIKLYNDTLTRLLTPIKANLEGLISAVSQDQSQNSGKRKKRFVGAVIGAAALGLATAAQVTATVALNQAQENARNILRLKNSIQKTNEAVMELKDAVGQTAVAIDKTQAFINNQILPAISNLSCEVLGNKIGVQLSLYLTELTTVFGNQLTNPALTTLSLQALYNLCGDDFNYLINLLNAKNRNLASLYEANLIQGRITQYDSMNQLLIIQVQIPSISTVSGMRVTELFTLSVDTPIGEGKALVPKYVLSSGRIMEEVDLSSCAITSTSVFCSSIISRPLPLETINCLNGNVTQCQFTANTGTLESRYAVIGGLVIANCKAIVCRCLNPPGVIAQNLGLPITIISSNTCQRINLEQITLSLGNSILSTYSANLSQVEMNLAPSNPLDISVELNRVNTSLSKVESLIKESNSILDSVNPQILNVKTVIILAVIIGLIVVWCFILTCLIVRGFMLLVKQQKFKGLSVQNNPYVSNNSH

SEQ ID NO: 30 - protein, 557 aa, Cedar virus
  MISC_FEATURE: fusion glycoprotein
MSNKRTTVLIIISYTLFYLNNAAIVGFDFDKLNKIGVVQGRVLNYKIKGDPMTKDLVLKFIPNIVNITECVREPLSRYNETVRRLLLPIHNMLGLYLNNTNAKMTGLMIAGVIMGGIAIGIATAAQITAGFALYEAKKNTENIQKLTDSIMKTQDSIDKLTDSVGTSILILNKLQTYINNQLVPNLELLSCRQNKIEFDLMLTKYLVDLMTVIGPNINNPVNKDMTIQSLSLLFDGNYDIMMSELGYTPQDFLDLIESKSITGQIIYVDMENLYVVIRTYLPTLIEVPDAQIYEFNKITMSSNGGEYLSTIPNFILIRGNYMSNIDVATCYMTKASVICNQDYSLPMSQNLRSCYQGETEYCPVEAVIASHSPRFALTNGVIFANCINTICRCQDNGKTITQNINQFVSMIDNSTCNDVMVDKFTIKVGKYMGRKDINNINIQIGPQIIIDKVDLSNEINKMNQSLKDSIFYLREAKRILDSVNISLISPSVQLFLIIISVLSFIILLIIIVYLYCKSKHSYKYNKFIDDPDYYNDYKRERINGKASKSNNIYYVGD

SEQ ID NO: 31 - protein, 546 aa, Rinderpest morbillivirus
  MISC_FEATURE: F protein
MGILFAALLAMTNPHLATGQIHWGNLSKIGVVGTGSASYKVMTQSSHQSLVIKLMPNVTAIDNCTKTEIMEYKRLLGTVLKPIREALNAITKNIKPIQSSTTSRRHKRFAGVVLAGAALGVATAAQITAGIALHQSMMNSQAIESLKASLETTNQAIEEIRQAGQEMVLAVQGVQDYINNELVPAMGQLSCEIVGQKLGLKLLRYYTEILSLFGPSLRDPVSAELSIQALSYALGGDINKILEKLGYSGSDLLAILESKGIKAKITYVDIESYFIVLSIAYPSLSEIKGVIVHRLESVSYNIGSQEWYTTVPRYVATQGYLISNFDDTPCAFTPEGTICSQNALYPMSPLLQECFRGSTRSCARTLVSGSIGNRFILSKGNLIANCASILCKCYTTGSIISQDPDKILTYIAADQCPVVEVGGVTIQVGSREYSDAVYLHEIDLGPPISLEKLDVGTNLWNAVTKLEKAKDLLDSSDLILENIKGVSVTNTGYILVGVGLIAVVGILIITCCCKKRRSDNKVSTMVLNPGLRPDLTGTSKSYVRSL

SEQ ID NO: 32 - protein, 536 aa, Avian paramyxovirus 10
  MISC_FEATURE: fusion protein
MTRTRLLFLLTCYIPGAVSLDNSILAPAGIISASERQIAIYTQTLQGTIALRFIPVLPQNLSSCAKDTLESYNSTVSNLLLPIAENLNALLKDADKPSQRIIGAIIGSVALGVATTAQVTAALAMTQAQQNARNIWKLKESIKNTNQAVLELKDGLQQSAIALDKVQSFINSEILPQINQLGCEVAANKLGIFLSLYLTEITTVFKNQITNPALSTLSYQALYNLCGGNMAALTKQIGIKDTEINSLYEAELITGQVIGYDSADQILLIQVSYPSVSRVQGVRAVELLTVSVATPKGEGKAIAPSFIAQSNIIAEELDTQPCKFSKTTLYCRQVNTRTLPVRVANCLKGKYNDCQYTTEIGALASRYVTITNGVVANCRSIICRCLDPEGIVAQNSDAAITVIDRSTCKLIQLGDITLRLEGKLSSSYSKNITIDISQVTTSGSLDISSELGSINNTITKVEDLISKSNDWLSKVNPTLISNDTIIALCVIAGIVVIWLVIITILSYYILIKLKNVALLSTMPKKDLNPYVNNTKF

SEQ ID NO: 33 - protein, 552 aa, Dolphin morbillivirus
  MISC_FEATURE: fusion protein
MAASNGGVMYQSFLTIIILVIMTEGQIHWGNLSKIGIVGTGSASYKVMTRPNHQYLVIKLMPNVTMIDNCTRTEVTEYRKLLKTVLEPVKNALTVITKNIKPIQSLTTSRRSKRFAGVVLAGVALGVATAAQITAGVALHQSIMNSQSIDNLRTSLEKSNQAIEEIRQASQETVLAVQGVQDFINNELIPSMHQLSCEMLGQKLGLKLLRYYTEILSIFGPSLRDPVSAEISIQALSYALGGDINKILEKLGYSGADLLAILESRGIKAKVTHVDLEGYFIVLSIAYPTLSEVKGVIVHKLEAVSYNLGSQEWYTTLPKYVATNGYLISNFDESSCAFMSEVTICSQNALYPMSPLLQQCLRGSTASCARSLVSGTIGNRFILSKGNLIANCASVLCKCYSTGTIISQDPDKLLTFVAADKCPLVEVDGITIQVGSREYPDSVYVSRIDLGPAISLEKLDVGTNLGSALTKLDNAKDLLDSSNQILENVRRSSFGGAMYIGILVCAGALVILCVLVYCCRRHCRKRVQTPPKATPGLKPDLTGTTKSYVRSL

SEQ ID NO: 34 - protein, 552 aa, Mossman virus
  MISC_FEATURE: fusion protein
MSNYFPARVIIIVSLITAVSCQISFQNLSTIGVFKFKEYDYRVSGDYNEQFLAIKMVPNVTGVENCTASLIDEYRHVIYNLLQPINTTLTASTSNVDPYAGNKKFFGAVIAGVALGVATAAQVTAGVALYEARQNAAAIAEIKESLHYTHKAIESLQISQKQTVVAIQGIQDQINTNIIPQINALTCEIANQRLRLMLLQYYTEMLSSFGPIIQDPLSGHITVQALSQAAGGNITGLMRELGYSSKDLRYILSVNGISANIIDADPEIGSIILRIRYPSMIKIPDVAVMELSYLAYHAAGGDWLTVGPRFILKRGYSLSNLDITSCTIGEDFLLCSKDVSSPMSLATQSCLRGDTQMCSRTAVQDREAPRFLLLQGNLIVNCMSVNCKCEDPEETITQDPAYPLMVLGSDTCKIHYIDGIRIKLGKVQLPPITVLNTLSLGPIVVLNPIDVSNQLSLVETTVKESEDHLKNAIGALRSQSRVGGVGIVAIVGLIIATVSLVVLVISGCCLVKYFSRTATLESSLTTIEHGPTLAPKSGPIIPTYINPVYRHD

SEQ ID NO: 35 - protein, 544 aa, J-virus
  MISC_FEATURE: fusion protein
MKPVALIYLTILAFTVKVRSQLALSDLTKIGIIPAKSYELKISTQAAQQLMVIKLIPNVNGLTNCTIPVMDSYKKMLDRILKPIDDALNHVKNAIQDKQGDGVPGVRFWGAIIGGVALGVATSAQITAGVALHNSIQNANAILQLKESIRNSNKAIEELQAGLQSTVLVINALQDQINSQLVPAINTLGCSVIANTLGLRLNQYFSEISLVFGPNLRDPTSQTLSIQAIAKAFNGDFDSMMKKMHYTDSDFLDLLESDSIRGRIISVSLEDYLIIIQIDYPGLTTIPNSVVQTFNLITYNYKGTEWESIFPRELLIRGSYISNIDISQCVGTSKSMICKSDTSTTISPATWACATGNLTSCARTRVVNSHSTRFALSGGVLFANCAPIACRCQDPQYSINQEPKTTNVMVTSEDCKELYIDGFYLTLGKKMLDRAMYAEDVALGGSVSVDPIDIGNELNSINESINKSHEYLDKANELLEQVNPNIVNVSSFSFILVISILLIIWFIVTLVWLIYLTKHMNFIVGKVAMGSRSSTVNSLSGFVG

SEQ ID NO: 36 - protein, 537 aa, Mapuera virus
  MISC_FEATURE: fusion protein
MRSSLFLVLTLLVPFAHSIDSITLEQYGTVITSVRSLAYFLETNPTYISVRLMPAIQTDSSHCSYHSIENYNLTLTKLLLPLQENLHQITDSLSSRRRKKRFAGVAVGLAALGVATAAQVTAAIAVVKAKENSAKIAQLTSAISETNRAVQDLIEGSKQLAVAVQAIQDQINNVIQPQLTNLSCQVADAQVGTILNMYLTELTTVFHPQITNSALTPITIQALRSLLGSTLPQVVTSTIKTDVPLQDLLTSGLLKGQIVYLDLQSMIMVVSVSVPTIALHSMAKVYTLKAISAHVNNAEVQMQVPSRVMELGSEIMGYDIDQCEETSRYLFCPYNGGSILSATMKMCLNGNISQCVFTPIYGSFLQRFVLVDGVIVANCRDMTCACKSPSKIITQPDSLPVTIIDSTSCSNLVLDTLELPIISINNATYRPVQYVGPNQIIFSQPLDLLSQLGKINSSLSDAIEHLAKSDEILEQIQWDSPQGYTLIALTSVLAFVVVAIVGLLISTRYLIFEIRRINTTLTQQLSSYVLSNKIIQY

SEQ ID NO: 37 - protein, 566 aa, Nariva virus
  MISC_FEATURE: fusion protein
MAEQEKTPLRYKILLIIIVINHYNITNVFGQIHLANLSSIGVFVTKTLDYRTTSDPTEQLLVINMLPNISNIQDCAQGVVNEYKHLISSLLTPINDTLDLITSNINPYSGRNKLFGEIIAGAALTVATSAQITAGVALYEARQNAKDIAAIKESLGYAYKAIDKLTTATREITVVINELQDQINNRLIPRINDLACEVWATRLQAMLLQYYAEIFSVIGPNLQDPLSGKISIQALARAAGGNIKLMVDELNYSGQDLSRLVKVGAIKGQIIDADPSLGVVIIKMRYPNIIKIPNVAISELSYVSYSSDGQDWITTGPNYIVTRGYSIANIQTSSCSVGDDFVLCDRDMTYPMSQVTQDCLRGNIALCSRMVVRDREAPRYLILQGNMVANCMSITCRCEEPESEIYQSPDQPLTLLTRDTCDTHVVDGIRIRLGVRKLPTISVINNITLGPIITTDPIDVSNQLNAVVSTIDQSAELLHQAQRVLSERARGARDHILATAAIVICVVLAVLILVLLIGLVYLYRTQNEILVKTTMLEQVPTFAPKSFPMESQIYSGKTNKGYDPAE

SEQ ID NO: 38 - protein, 662 aa, Bat Paramyxovirus Eid_hel/GH-M74a/GHA/2009
  MISC_FEATURE: fusion protein
MKKKTDNPTISKRGHNHSRGIKSRALLRETDNYSNGLIVENLVRNCHHPSKNNLNYTKTQKRDSTIPYRVEERKGHYPKIKHLIDKSYKHIKRGKRRNGHNGNIITIILLLILILKTQMSEGAIHYETLSKIGLIKGITREYKVKGTPSSKDIVIKLIPNVTGLNKCTNISMENYKEQLDKILIPINNIIELYANSTKSAPGNARFAGVIIAGVALGVAAAAQITAGIALHEARQNAERINLLKDSISATNNAVAELQEATGGIVNVITGMQDYINTNLVPQIDKLQCSQIKTALDISLSQYYSEILTVFGPNLQNPVTTSMSIQAISQSFGGNIDLLLNLLGYTANDLLDLLESKSITGQITYINLEHYFMVIRVYYPIMTTISNAYVQELIKISFNVDGSEWVSLVPSYILIRNSYLSNIDISECLITKNSVICRHDFAMPMSYTLKECLTGDTEKCPREAVVTSYVPRFAISGGVIYANCLSTTCQCYQTGKVIAQDGSQTLMMIDNQTCSIVRIEEILISTGKYLGSQEYNTMHVSVGNPVFTDKLDITSQISNINQSIEQSKFYLDKSKAILDKINLNLIGSVPISILFIIAILSLILSIITFVIVMIIVRRYNKYTPLINSDPSSRRSTIQDVYIIPNPGEHSIRSAARSIDRDRD

SEQ ID NO: 39 - protein, 539 aa, Avian paramyxovirus 7
  MISC_FEATURE: fusion protein
MRVRPLIIILVLLVLLWLNILPVIGLDNSKIAQAGIISAQEYAVNVYSQSNEAYIALRTVPYIPPHNLSCFQDLINTYNTTIQNIFSPIQDQITSITSASTLPSSRFAGLVVGAIALGVATSAQITAAVALTKAQQNAQEIIRLRDSIQNTINAVNDITVGLSSIGVALSKVQNYLNDVINPALQNLSCQVSALNLGIQLNLYLTEITTIFGPQITNPSLTPLSIQALYTLAGDNLMQFLTRYGYGETSVSSILESGLISAQIVSFDKQTGIAILYVTLPSIATLSGSRVTKLMSVSVQTGVGEGSAIVPSYVIQQGTVIEEFIPDSCIFTRSDVYCTQLYSKLLPDSILQCLQGSMADCQFTRSLGSFANRFMTVAGGVIANCQTVLCRCYNPVMIIPQNNGIAVTLIDGSLCKELELEGIRLTMADPVFASYSRDLIINGNQFAPSDALDISSELGQLNNSISSATDNLQKAQESLNKSIIPAATSSWLIILLFVLVSISLVIGCISIYFIYKHSTTNRSRNLSSDIISNPYIQKAN

SEQ ID NO: 40 - protein, 539 aa, Tuhoko virus 2
  MISC_FEATURE: fusion protein
MAPCVLFLSSLLLISTISPSHGINQPALRRIGAIVSSVKQLKFYSKTKPNYIIVKLLPTINLSKSNCNLTSINRYKESVIEIIKPLADNIDNLNQKLLPKNRRKRMAGVAIGLAALGVAAAAQATAAVALVEARKNTQMIQSLADSIQDTNAAVQAVNIGLQNSAVAIQAIQNQINNVINPALDRLNCEVLDAQIASILNLYLIKSVTIFQNQLTNPALQQLSIQMLSIVMQDTAKILGNFTIGDKFDQHDLLGSGLITGQVVGVNLTNLQLIIAAFIPSIAPLPQAYIIDLISITISVNDTEAVIQIPERIMEHGSSIYQFGGKQCVYGQFSAYCPFSDAVLMTQDLQLCMKGNIEHCIFSSVLGSFPNRFASVDGVFYANCKYMSCACSDPLQVIHQDDSVNLMVIDSSVCRSLTLGHVTFPIIAFSNVSYQMKTNISIEQMIVTSPLDLSTELKQINNSVNIANTFLDSSNRALKTSIFGTSSQIILIVLLIFTCLLILYVIFLTYIIKILIKEVKRLRDGNSRTGSKLSFINPDV

SEQ ID NO: 41 - protein, 537 aa, Tuhoko virus 3
  MISC_FEATURE: fusion protein
MLWLTILIALVGNHESTCMNINFLQSLGQINSQKRFLNFYTQQPPSYMVIRLVPTLQLSANNCTLGSIVRYRNAIKELIQPMDENLRWLSSNLIPQRRGKRFAGVAVGLAALGVAVAAQATAAVALVEARANAEKIASMSQSIQETNKAVTSLSQAVSASGIAIQAIQNEINNVIHPILNQVQCDVLDARVGNILNLYLIKVTTIFQNQLTNPALQRLSTQALSMLMQSTSSYLRNLSSSESAINADLSMTNLIEAQIVGINMTNLQLVLAVFIPSIARLNGALLYDFISITISSNQTEVMLQIPHRVLEIGNSLYTFEGTQCEMTKLNAYCLYSDAIPVTESLRDCMNGLFSQCGFVRIIGSFANRFASVNGVIYANCKHLTCSCLQPDEIITQDTNVPLTIIDTKRCTKISLGHLTFTIREYANVTYSLRTEIANSQITVVSPLDLSSQLTTINNSLADATNHIMNSDRILDRLNSGLYSKWVIIFLICASIVSLIGLVFLGFLIRGLILELRSKHRSNLNKASTYSIDSSIGLT

SEQ ID NO: 42 - protein, 545 aa, Mojiang virus
  MISC_FEATURE: fusion protein
MALNKNMFSSLFLGYLLVYATTVQSSIHYDSLSKVGVIKGLTYNYKIKGSPSTKLMVVKLIPNIDSVKNCTQKQYDEYKNLVRKALEPVKMAIDTMLNNVKSGNNKYRFAGAIMAGVALGVATAATVTAGIALHRSNENAQAIANMKSAIQNTNEAVKQLQLANKQTLAVIDTIRGEINNNIIPVINQLSCDTIGLSVGIRLTQYYSEIITAFGPALQNPVNTRITIQAISSVFNGNFDELLKIMGYTSGDLYEILHSELIRGNIIDVDVDAGYIALEIEFPNLTLVPNAVVQELMPISYNIDGDEWVTLVPRFVLTRTTLLSNIDTSRCTITDSSVICDNDYALPMSHELIGCLQGDTSKCAREKVVSSYVPKFALSDGLVYANCLNTICRCMDTDTPISQSLGATVSLLDNKRCSVYQVGDVLISVGSYLGDGEYNADNVELGPPIVIDKIDIGNQLAGINQTLQEAEDYIEKSEEFLKGVNPSIITLGSMVVLYIFMILIAIVSVIALVLSIKLTVKGNVVRQQFTYTQHVPSMENINYVSH

SEQ ID NO: 43 - protein, 546 aa, Avian paramyxovirus 12
  MISC_FEATURE: fusion protein
MAIPVPSSTALMIFNILVSLAPASALDGRLLLGAGIVPTGDRQVNVYTSSQTGIIALKLLPNLPKDKENCAEVSIRSYNETLTRILTPLAQSMAAIRGNSTVSTRGREPRLVGAIIGGVALGVATAAQITAATALIQANQNAENIARLAKGLAATNEAVTDLTKGVGSLAIGVGKLQDYVNEQFNRTGEAIECLTIESRVGVQLSLYLTEVIGVFGDQITSPALSDISIQALYNLAGGNLNVLLQKMGIEGTQLGSLINSGLIKGRPIMYDDGNKILGIQVTLPSVGRINGARATLLEAIAVATPKGNASPLIPRAVISVGSLVEELDMTPCVLTPTDIFCTRILSYPLSDSLTTCLKGNLSSCVFSRTEGALSTPYVSVHGKIVANCKSVVCRCVEPQQIISQNYGEALSLIDESLCRILELNGVILKMDGQFTSEYTKNITIDPVQVIISGPIDISSELSQVNQSLDSALENIKESNSYLSKVNVKLISSSAMITYIVITVICLILTFVALVLGIYSYTKIRSQQKTLIWMGNNIARSKEGNRF

SEQ ID NO: 44 - protein, 538 aa, Avian paramyxovirus 3
  MISC_FEATURE: fusion protein
  misc_feature (287)..(287): Xaa can be any naturally occurring amino acid
MASPMVPLLIITVVPALISSQSANIDKLIQAGIIMGSGKELHIYQESGSLDLYLRLLPVIPSNLSHCQSEVITQYNSTVTRLLSPIAKNLNHLLQPRPSGRLFGAVIGSIALGVATSAQISAAIALVRAQQNANDILALKAAIQSSNEAIKQLTYGQEKQLLAISKIQKAVNEQVIPALTALDCAVLGNKLAAQLNLYLIEMTTIFGDQINNPVLTPIPLSYLLRLTGSELNDVLLQQTRSSLSLIHLVSKGLLSGQIIGYDPSVQGIIIRIGLIRTQRIDRSLVFXPYVLPITISSNIATPIIPDCVVKKGVIIEGMLKSNCIELERDIICKTINTYQITKETRACLQGNITMCKYQQSRTQLSTPFITYNGVVIANCDLVSCRCIRPPMIITQVKGYPLTIINRNLCTELSVDNLILNIETNHNFSLNPTIIDSQSRLIATSPLEIDALIQDAQHHAAAALLKVEESNAHLLRVTGLGSSSWHIILILTLLVCTIAWLIGLSIYVCRIKNDDSTDKEPTTQSSNRGIGVGSIQYMT

SEQ ID NO: 45 - protein, 552 aa, Salem virus
  MISC_FEATURE: fusion protein
MNPLNQTLIAKVLGFLLLSSSFTVGQIGFENLTRIGVHQVKQYGYKLAHYNSHQLLLIRMIPTVNGTHNCTHQVITRYREMVREIITPIKGALDIMKKAVSPDLVGARIFGAIVAGAALGIATSAQITAGVALHRTKLNGQEISKLKEAVSLTNEAVEQLQYSQGKSILAIQGIQDFINFNVVPLLEEHTCGIAKLHLEMALMEYFQKLILVFGPNLRDPIGSTIGIQALATLFQNNMFEVSLRLGYAGDDLEDVLQSNSIRANIIEAEPDSGFIVLAIRYPTLTLVEDQVITELAHITFNDGPQEWVATIPQFVTYRGLVLANIDVSTCTFTERNVICARDQTYPMIIDLQLCMRGNIAKCGRTRVTGSTASRFLLKDGNMYANCIATMCRCMSSSSIINQEPSHLTTLIVKETCSEVMIDTIRITLGERKHPPIDYQTTITLGQPIALAPLDVGTELANAVSYLNKSKVLLEHSNEVLSSVSTAHTSLTATIVLGIVVGGLAILIVVMFLFLEAQVIKVQRAMMLCPITNHGYLPNEDLLTRGHSIPTIG

SEQ ID NO: 46 - protein, 551 aa, Avian paramyxovirus 9
  MISC_FEATURE: fusion protein
MGYFHLLLILTAIAISAHLCYTTTLDGRKLLGAGIVITEEKQVRVYTAAQSGTIVLRSFRVVSLDRYSCMESTIESYNKTVYNILAPLGDAIRRIQASGVSVERIREGRIFGAILGGVALGVATAAQITAAIALIQANENAKNILRIKDSITKTNEAVRDVTNGVSQLTIAVGKLQDFVNKEFNKTTEAINCVQAAQQLGVELSLYLTEITTVFGPQITSPALSKLTIQALYNLAGVSLDVLLGRLGADNSQLSSLVSSGLITGQPILYDSESQILALQVSLPSISDLRGVRATYLDTLAVNTAAGLASAMIPKVVIQSNNIVEELDTTACIAAEADLYCTRITTFPIASAVSACILGDVSQCLYSKTNGVLTTPYVAVKGKIVANCKHVTCRCVDPTSIISQNYGEAATLIDDQLCKVINLDGVSIQLSGTFESTYVRNVSISANKVIVSSSIDISNELENVNSSLSSALEKLDESDAALSKVNVHLTSTSAMATYIVLTVIALILGFVGLGLGCFAMIKVKSQAKTLLWLGAHADRSYILQSKPAQSST

SEQ ID NO: 47 - protein, 533 aa, Achimota virus 1
  MISC_FEATURE: fusion protein
MWIMIILSLFQIIPGVTPINSKVLTQLGVITKHTRQLKFYSHSTPSYLVVKLVPTINTESTVCNFTSLSRYKDSVRELITPLAKNIDNLNSILTIPKRRKRMAGVVIGLAALGVAAAAQATAAVALIEAKKNTEQIQALSESIQNTNKAVSSIEKGLSSAAIAVQAIQNQINNVINPALTALDCGVTDAQLGNILNLYLIKTLTVFQKQITNPALQPLSIQALNIIMQETSSVLRNFTKTDEIEHTDLLTSGLITGQVVGVNLTNLQLIIAAFIPSIAPLNQAYILDFIRITVNINNSESMIQIPERIMEHGISLYQFGGDQCTFSDWSAYCPYSDATLMAPGLQNCFRGQAADCVFSTVMGSFPNRFVSVQGVFYVNCKFIRCACTQPQRLITQDDSLSLTQIDAKTCRMLTLGFVQFSINEYANVTYSFKNNVTAGQLIMTNPIDLSTEIKQMNDSVDEAARYIEKSNAALNKLMYGGRSDIVTTVLLVGFILLVVYVIFVTYILKILMKEVARLRNSNHPDLIKPYNYPM

SEQ ID NO: 48 - protein, 531 aa, Achimota virus 2
  MISC_FEATURE: fusion protein
MLNSFYQIICLAVCLTTYTVISIDQHNLLKAGVIVKSIKGLNFYSRGQANYIIVKLIPNVNVTDTDCDIGSIKRYNETVYSLIKPLADNIDYLRTQFAPTKRKKRFAGVAIGLTALGVATAAQVTAAVALVKAQENARKLDALADSIQATNEAVQDLSTGLQAGAIAIQAIQSEINHVINPALERLSCEIIDTRVASILNLYLIRLTTVFHRQLVNPALTPLSIQALNHLLQGETEGLVKNESKMTDSKIDLLMSGLITGQVVGVNIKHMQLMIAVFVPTTAQLPNAYVINLLTITANINNSEVLVQLPNQILERSGIIYQFRGKDCVSSPNHMYCPYSDASILSPELQLCLQGRLEMCLFTQVVGSFPTRFASDKGIVYANCRHLQCACSEPEGIIYQDDTSAITQIDASKCSTLKLDMLTFKLSTYANKTFDASFSVGKDQMLVTNLLDLSAELKTMNASVAHANKLIDKSNLLIQSNALIGHSNTIFIVVIVILAVMVLYLIIVTYIIKVIMVEVSRLKRMNIYSIDK

SEQ ID NO: 49 - protein, 532 aa, Tuhoko virus 1
  MISC_FEATURE: fusion protein
MVTIIKPLILLVTVILQISGHIDTTALTSIGAVIASSKEIMYYAQSTPNYIVIKLIPNLPNIPSQCNFSSIAYYNKTLLDLFTPISDNINMLHQRLSNTGRNRRFAGVAIGLAALGVATAAQVTAAFALVEAKSNTAKIAQIGQAIQNTNAAINSLNAGIGGAVTAIQAIQTQINGIITDQINAATCTALDAQIGTLLNMYLLQLTTTFQPQIQNPALQPLSIQALHRIMQGTSIVLSNLTDSSKYGLNDALSAGLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVIIANCKFIRCTCLQPEGIISQLDDHTLTVIDLKLCNKLDLGLIQFDLQVLSNISYEMTLNTSQNQLILTDPLDLSSELQTMNQSINNAANFIEKSNSLLNSSTYEFNRSVALLVALILLSLTILYVIVLTCVVKLLVHEVSKNRRHIQDLESHHK

SEQ ID NO: 50 - protein, 631 aa, Phocine distemper virus
  MISC_FEATURE: fusion protein
MTRVKKLPVPTNPPMHHSLDSPFLNPEHATGKISITDDTSSQLTNFLYHKYHKTTINHLSRTISGTDPPSAKLNKFGSPILSTYQIRSALWWIAMVILVHCVMGQIHWTNLSTIGIIGTDSSHYKIMTRSSHQYLVLKLMPNVSIIDNCTKAELDEYEKLLNSVLEPINQALTLMTKNVKSLQSLGSGRRQRRFAGVVIAGAALGVATAAQITAGVALYQSNLNAQAIQSLRASLEQSNKAIDEVRQASQNIIIAVQGVQDYVNNEIVPALQHMSCELIGQRLGLKLLRYYTELLSVFGPSLRDPVSAEISIQALSYALGGEIHKILEKLGYSGNDMVAILETKGIRAKITHVDLSGKFIVLSISYPTLSEVKGVVVHRLEAVSYNIGSQEWYTTVPRYVATNGYLISNFDESSCVFVSESAICSQNSLYPMSPILQQCLRGETASCARTLVSGTLGNKFILSKGNIIANCASILCKCHSTSKIINQSPDKLLTFIASDTCSLVEIDGVTIQVGSRQYPDVVYASKVILGPAISLERLDVGTNLGSALKKLNDAKVLIESSDQILDTVKNSYLSLGTLIALPVSIGLGLILLLLICCCKKRYQHLFSQSTKVAPVFKPDLTGTSKSYVRSL

SEQ ID NO: 51 - protein, 541 aa, Caprine parainfluenza virus 3
  MISC_FEATURE: fusion protein
MIKKIICIFSMPILLSFCQVDIIKLQRVGILVSKPKSIKISQNFETRYLVLNLIPNIENAQSCGDQQIKQYKKLLDRLIIPLYDGLRLQQDIIVVDNNLKNNTNHRAKRFFGEIIGTIALGVATSAQITAAVALVEAKQARSDIERVKNAVRDTNKAVQSIQGSVGNLIVAVKSVQDYVNNEIVPSIKRLGCEAAGLQLGIALTQHYSELTNIFGDNIGTLKEKGIKLQGIASLYHTNITEIFTTSTVDQYDIYDLLFTESIKMRVIDVDLNDYSITLQVRLPLLTKISDAQIYNVDSVSYNIGGTEWYIPLPRNIMTKGAFLGGANLQDCIESFSDYICPSDPGFILNRDIENCLSGNITQCPKTLVISDIVPRYAFVDGGVIANCLSTTCTCNGIDNRINQAPDQGIKIITYKDCQTIGINGMLFKTNQEGTLAAYTPVDITLNNSVNLDPIDLSIELNRARSDLAESKEWIKRSEAKLDSVGSWYQSSTTEIIQIVMIIVLFIINIIVLIVLIKYSRSQNQSMNNHMNEPYILTNKVQ

SEQ ID NO: 52 - protein, 553 aa, Tupaia paramyxovirus
  MISC_FEATURE: fusion protein
MASLLKTICYIYLITYAKLEPTPKSQLDLDSLASIGVVDAGKYNYKLMTTGSEKLMVIKLVPNITYATNCNLTAHTAYTKMIERLLTPINQSLYEMRSVITERDGGTIFWGAIIAGAALGVATAAAITAGVALHRAEQNARNIAALKDALRNSNEAIQHLKDAQGHTVLAIQGLQEQINNNIIPKLKESHCLGVNNQLGLLLNQYYSEILTVFGPNLQNPVSASLTIQAIAKAFNGDFNSLMTNLNYDPTDLLDILESNSINGRIIDVNLNEKYIALSIEIPNFITLTDAKIQTFNRITYGYGSNEWLTLIPDNILEYGNLISNVDLTSCVKTKSSYICNQDTSYPISSELTRCLRGDTSSCPRTPVVNSRAPTFALSGGHIYANCAKAACRCEKPPMAIVQPATSTLTFLTEKECQEVVIDQINIQLAPNRLNKTIITDGIDLGPEVIINPIDVSAELGNIELEMDKTQKALDRSNKILDSMITEVTPDKLLIAMIVVFGILLLWLFGVSYYAFKIWSKLHFLDSYVYSLRNPSHHRSNGHQNHSFSTDISG

SEQ ID NO: 53 - protein, 543 aa, Avian paramyxovirus 3
  MISC_FEATURE: fusion protein
MQPGSALHLPHLYIIIALVSDGTLGQTAKIDRLIQAGIVLGSGKELHISQDSGTLDLFVRLLPVLPSNLSHCQLEAITQYNKTVTRLLAPIGKNLEQVLQARPRGRLFGPIIGSIALGVATSAQITAAIALVRAQQNANDILALKNALQSSNEAIRQLTYGQDKQLLAISKIQKAVNEQILPALDQLDCAVLGTKLAVQLNLYLIEMTTIFGEQINNPVLATIPLSYILRLTGAELNNVLMKQARSSLSLVQLVSKGLLSGQVIGYDPSVQGLIIRVNLMRTQKIDRALVYQPYVLPITLNSNIVTPIAPECVIQKGTIIEGMSRKDCTELEQDIICRTVTTYTLARDTRLCLQGNISSCRYQQSGTQLHTPFITYNGAVIANCDLVSCRCLRPPMIITQVKGYPLTIITRSVCQELSVDNLVLNIETHHNFSLNPTIIDPLTRVIATTPLEIDSLIQEAQDHANAALAKVEESDKYLRAVTGGNYSNWYIVLVIVLLFGNLGWSLLLTVLLCRSRKQQRRYQQDDSVGSERGVGVGTIQYMS

SEQ ID NO: 54 - protein, 541 aa, Avian paramyxovirus 14
  MISC_FEATURE: fusion protein
MEKGTVLFLAALTLYNVKALDNTKLLGAGIASGKEHELKIYQSSVNGYIAVKLIPFLPSTKRECYNEQLKNYNATINRLMGPINDNIKLVLSGVKTRTREGKLIGAIIGTAALGLATAAQVTAAIALEQAQDNARAILTLKESIRNTNNAVSELKTGLSEVSIALSKTQDYINTQIMPALSNLSCEIVGLKIGIQLSQYLTEVTAVFGNQITNPALQPLSMQALYQLCGGDFSLLLDKIGADRNELESLYEANLVTGRIVQYDTADQLVIIQVSIPSVSTLSGYRVTELQSISVDMDHGEGKAVIPRYIVTSGRVIEEMDISPCVLTATAVYCNRLLTTSLPESVLKCLDGDHSSCTYTSNSGVLETRYIAFDGMLIANCRSIVCKCLDPPYIIPQNKGKPLTIISKEVCKKVTLDGITLLIDAEFTGEYGLNITIGPDQFAPSGALDISTELGKLNNSINKAEDYIDKSNELLNRVNVDIVNDTAVIVLCVMSALVVVWCIGLTVGLIYVSKNTLRAVAIKGTSIENPYVSSGKHAKNSS

SEQ ID NO: 55 - protein, 551 aa, Avian paramyxovirus UPO216
  MISC_FEATURE: fusion protein
MIFTMYHVTVLLLLSLLTLPLGIQLARASIDGRQLAAAGIVVTGEKAINLYTSSQTGTIVVKLLPNVPQGREACMRDPLTSYNKTLTSLLSPLGEAIRRIHESTTETAGLVQARLVGAIIGSVALGVATSAQITAAAALIQANKNAENILKLKQSIAATNEAVHEVTDGLSQLAVAVGKMQDFINTQFNNTAQEIDCIRISQQLGVELNLYLTELTTVFGPQITSPALSPLSIQALYNLAGGNLDVLLSKIGVGNNQLSALISSGLISGSPILYDSQTQLLGIQVTLPSVSSLNNMRAIFLETLSVSTDKGFAAALIPKVVTTVGTVTEELDTSYCIETDIDLFCTRIVTFPMSPGIYACLNGNTSECMYSKTQGALTTPYMSVKGSIVANCKMTTCRCADPASIISQNYGEAVSLIDSSVCRVITLDGVTLRLSGSFDSTYQKNITIRDSQVIITGSLDISTELGNVNNSINNALDKIEESNQILESVNVSLTSTNALIVYIICTALALICGITGLILSCYIMYKMRSQQKTLMWLGNNTLDQMRAQTKM

SEQ ID NO: 56 - protein, 552 aa, Atlantic salmon paramyxovirus
  MISC_FEATURE: fusion protein
MDGPKFRFVLLILLTAPARGQVDYDKLLKVGIFEKGTANLKISVSSQQRYMVIKMMPNLGPMNQCGIKEVNLYKESILRLITPISTTLNYIKSEIQVEREVALQPNGTIVRFFGLIVAAGALTLATSAQITAGIALHNSLENAKAIKGLTDAIKESNLAIQKIQDATAGTVIALNALQDQVNTNIIPAINTLGCTAAGNTLGIALTRYYSELIMIFGPSLGNPVEAPLTIQALAGAFNGDLHGMIREYGYTPSDIEDILRTNSVTGRVIDVDLVGMNIVLEINLPTLYTLRDTKIVNLGKITYNVDGSEWQTLVPEWLAIRNTLMGGVDLSRCVVSSRDLICKQDPVFSLDTSIISCLNGNTESCPRNRVVNSVAPRYAVIRGNILANCISTTCLCGDPGVPIIQKGDNTLTAMSINDCKLVGVDGYVFRPGPKAVNVTFNLPHLNLGPEVNVNPVDISGALGKVEQDLASSRDHLAKSEKILSGINPNIINTEMVLVAVILSLVCAMVVIGIVCWLSILTKWVRSCRADCRRPNKGPDLGPIMSSQDNLSF

SEQ ID NO: 57 - protein, 546 aa, Nipah virus
  MISC_FEATURE: Fusion glycoprotein F0
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 58 - protein, 321 aa, Human respiratory syncytial virus
  MISC_FEATURE: attachment glycoprotein
MSKTKDQRTAKTLERTWDTLNHLLFISSCLYKLNLKSIAQITLSILAMIISTSLIIAAIIFIASANHKVTLTTAIIQDATNQIKNTTPTYLTQNPQLGISFSNLSGTTLQSTTILASTTPSAESTPQSTTVKIINTTTTQILPSKPTTKQRQNKPQNKPNNDFHFEVFNFVPCSICSNNPTCWAICKRIPNKKPGKKTTTKPTKKPTLKTTKKDPKPQTTKPKEALTTKPTGKPTINTTKTNIRTTLLTSNTKGNPEHTSQEETLHSTTSEGYLSPSQVYTTSGQEETLHSTTSEGYLSPSQVYTTSEYLSQSLSSSNTTK

SEQ ID NO: 59 - protein, 616 aa, Newcastle disease virus
  MISC_FEATURE: hemagglutinin-neuraminidase protein
MERGVSQVALENDEREAKNTWRLVFRVTVLFLTIVTLAISAAALAFSMNASTPQDLEGIPVAISKVEDKITSALGASQDVMDRIYKQVALESPLALLNTESTIMNALTSLSYQINGAANASGCGAPVPDPDYIGGIGKELIVDDTSDVTSFYPSAFQEHLNFIPAPTTGSGCTRIPSFDMSATHYCYTHNVILSGCRDHSHSHQYLALGVLRTSATGRVFFSTLRSINLDDTQNRKSCSVSATPLGCDMLCSKVTETEEEDYQSTDPTLMVHGRLGFDGQYHERDLDVHTLFGDWVANYPGVGGGSFINNRVWFPVYGGLKPGSPTDKRQEGQYAIYKRYNDTCPDDQEYQVRMAKSAYKPNRFGGKRVQQAILSIGVSTTLADDPVLTVTSNTITLMGAEGRVMTVGTSHYLYQRGSSYYSPAILYPLTIANKTATLQDPYKFNAFTRPGSVPCQASARCPNSCVTGVYTDPYPIVFHKNHTLRGVFGTMLDDEQARLNPVSAVFDSIARSRVTRVSSSSTKAAYTTSTCFKVVKTGKVYCLSIAEISNTLFGEFRIVPLLVEILRDEGRSEARSALTTQGHPGWNDEVVDPIFCAVTNQTDHRQKLEEYAQSWP

SEQ ID NO: 60 - protein, 316 aa, Human respiratory syncytial virus
  MISC_FEATURE: receptor-binding glycoprotein
MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSETHHTTAQTKGRTTTPTQNNKPSTKPRPKNPPKKPKDDYHFEVFNFVPCSICGNNQLCKSICKTIPNNKPKKKPTTKPTNKPPTKTTNKRDPKTPAKTLKKETTINPTTKKPTPKTTERDTSTPQSTVLDTTTSKHTERDTSTPQSTVLDTTTSKHTIQQQSLHSITPENTPNSTQTPTASEPSTSNSTQKL

SEQ ID NO: 61 - protein, 621 aa, Measles virus
  MISC_FEATURE: Hemagglutinin
MSPHRDRINAFYRDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVGKPNLSSKGSELSQLSMHRVFEVGVIRNPGLGAPVFHMTNYFEQPVSNDFSNCMVALGELRFAALCHREDSVTVPYQGSGKGVSFQLVKLGVWKSPTDMQSWVPLSTDDPVIDRLYLSSHRGVIADNQAKWAVPTTRTDDKLRMETCFQQACKGKNQALCENPEWAPLKDNRIPSYGVLSVNLSLTVELKIKIASGFGPLITHGSGMDLYKTNHDNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNRRQGCQ

SEQ ID NO: 62 - protein, 582 aa, Mumps virus
  MISC_FEATURE: hemagglutinin-neuraminidase
MEPSKLFTMSDNATFAPGPVINAADKKTFRTCFRILVLSVQAVTLILVIVTLGELVRMINDQGLSNQLSSIADKIRESATMIASAVGVMNQVIHGVTVSLPLQIEGNQNQLLSTLATICTGKKQVSNCSTNIPLVNDLRFINGINKFIIEDYATHDFSIGHPLNMPSFIPTATSPNGCTRIPSFSLGKTHWCYTHNVINANCKDHTSSNQYISMGILVQTASGYPMFKTLKIQYLSDGLNRKSCSIATVPDGCAMYCYVSTQLETDDYAGSSPPTQKLTLLFYNDTVTERTISPTGLEGNWATLVPGVGSGIYFENKLIFPAYGGVLPNSSLGVKSAREFFRPVNPYNPCSGPQQDLDQRALRSYFPSYFSNRRVQSAFLVCAWNQILVTNCELVVPSNNQTLMGAEGRVLLINNRLLYYQRSTSWWPYELLYEISFTFTNSGQSSVNMSWIPIYSFTRPGSGNCSGENVCPTACVSGVYLDPWPLTPYSHQSGINRNFYFTGALLNSSTTRVNPTLYVSALNNLKVLAPYGNQGLFASYTTTTCFQDTGDASVYCVYIMELASNIVGEFQILPVLTRLTIT

SEQ ID NO: 63 - protein, 572 aa, Human respirovirus 3
  MISC_FEATURE: hemagglutinin-neuraminidase
MEYWKHTNHGKDAGNELETATATHGNRLTNKITYILWTITLVLLSIVFIIVLINSIKSEKAHESLLQDINNEFMEVTEKIQVASDNTNDLIQSGVNTRLLTIQSHVQNYIPISLTQQISDLRKFISEITIRNDNQEVPPQRITHDVGIKPLNPDDFWRCTSGLPSLMRTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDGSISTTRFKNNNISFDQPYAALYPSVGPGIYYKGKIIFLGYGGLEHPINENAICNTTGCPGKTQRDCNQASHSPWFSDRRMVNSIIVVDKGLNSVPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNKTLSAGYTTTSCITHYNKGYCFHIVEINHKSLNTFQPMLFKTEIPKSCS

SEQ ID NO: 64 - protein, 220 aa, Human metapneumovirus
  MISC_FEATURE: attachment glycoprotein G
MEVKVENIRAIDMLKARVKNRVARSKCFKNASLILIGITTLSIALNIYLIINYTIQKTTSESEHHTSSPPTESNKETSTIPIDNPDITPNSQHPTQQSTESLTLYPASSMSPSETEPASTPGITNRLSLADRSTTQPSESRTKTNSTVHKKNKKNISSTISRTQSPPRTTAKAVSRTTALRMSSTGERPTTTSVQSDSSTTAQNHEETGPANPQASVSTM

SEQ ID NO: 65 - protein, 607 aa, Canine distemper virus
  MISC_FEATURE: hemagglutinin
MLSYQDKVGAFYKDNARANSSKLSLVTEEQGGRRPPYLLFVLLILLVGILALLAIAGVRFRQVSTSNVEFGRLLKDDLEKSEAVHHQVMDVLTPLFKIIGDEIGLRLPQKLNEIKQFILQKTNFFNPNREFDFRDLHWCINPPSKIKVNFTNYCDAIGVRKSIASAANPILLSALSGGRGDIFPPYRCSGATTSVGRVFPLSVSLSMSLISKTSEIISMLTAISDGVYGKTYLLVPDYIEREFDTQKIRVFEIGFIKRWLNDMPLLQTTNYMVLPENSKAKVCTIAVGELTLASLCVDESTVLLYHDSNGSQDSILVVTLGIFGATPMNQVEEVIPVAHPSVERIHITNHRGFIKDSVATWMVPALVSEQQEGQKNCLESACQRKSYPMCNQTSWEPFGGVQLPSYGRLTLPLDASIDLQLNISFTYGPVILNGDGMDYYENPLLDSGWLTIPPKNGTILGLINKASRGDQFTVTPHVLTFAPRESSGNCYLPIQTSQIMDKDVLTESNLVVLPTQNFRYVVATYDISRENHAIVYYVYDPIRTISYTYPFRLTTKGRPDFLRIECFVWDDDLWCHQFYRFESDITNSTTSVEDLVRIRFSCNRSKP

SEQ ID NO: 66 - protein, 609 aa, Peste-des-petits-ruminants virus
  MISC_FEATURE: haemagglutinin
MSAQRERINAFYKDNPHNKNHRVILDRERLVIERPYILLGVLLVMFLSLIGLLAIAGIRLHRATVGTSEIQSRLNTNIELTESIDHQTKDVLTPLFKIIGDEVGIRIPQKFSDLVKFISDKIKFLNPDREYDFRDLRWCMNPPERVKINFDQFCEYKAAVKSIEHIFESPLNKSKKLQSLTLGPGTGCLGRTVTRAHFSELTLTLMDLDLEMKHNVSSVFTVVEEGLFGRTYTVWRSDARDPSTDLGIGHFLRVFEIGLVRDLGLGPPVFHMTNYLTVNMSDDYRRCLLAVGELKLTALCSSSETVTLGERGVPKREPLVVVILNLAGPTLGGELYSVLPTSDLMVEKLYLSSHRGIIKDDEANWVVPSTDVRDLQNKGECLVEACKTRPPSFCNGTGSGPWSEGRIPAYGVIRVSLDLASDPGVVITSVFGPLIPHLSGMDLYNNPFSRAVWLAVPPYEQSFLGMINTIGFPNRAEVMPHILTTEIRGPRGRCHVPIELSRRVDDDIKIGSNMVILPTIDLRYITATYDVSRSEHAIVYYIYDTGRSSSYFYPVRLNFKGNPLSLRIECFPWRHKVWCYHDCLIYNTITDEEVHTRGLTGIEVTCNPV

SEQ ID NO: 67 - protein, 575 aa, Sendai virus
  MISC_FEATURE: hemagglutinin-neuraminidase protein
MDGDRSKRDSYWSTSPGGSTTKLVSDSERSGKVDTWLLILAFTQWALSIATVIICIVIAARQGYSMERYSMTVEALNTSNKEVKESLTSLIRQEVITRAANIQSSVQTGIPVLLNKNSRDVIRLIEKSCNRQELTQLCDSTIAVHHAEGIAPLEPHSFWRCPAGEPYLSSDPEVSLLPGPSLLSGSTTISGCVRLPSLSIGEAIYAYSSNLITQGCADIGKSYQVLQLGYISLNSDMFPDLNPVVSHTYDINDNRKSCSVVATGTRGYQLCSMPIVDERTDYSSDGIEDLVLDILDLKGRTKSHRYSNSEIDLDHPFSALYPSVGSGIATEGSLIFLGYGGLTTPLQGDTKCRIQGCQQVSQDTCNEALKITWLGGKQVVSVLIQVNDYLSERPRIRVTTIPITQNYLGAEGRLLKLGDQVYIYTRSSGWHSQLQIGVLDVSHPLTISWTPHEALSRPGNEDCNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAES

SEQ ID NO: 68 - protein, 575 aa, Human parainfluenza virus 1 strain Washington/1964
  MISC_FEATURE: HN glycoprotein
MAEKGKTNSSYWSTTRNDNSTVNTHINTPAGRTHIWLLIATTMHTVLSFIIMILCIDLIIKQDTCMKTNIMTVSSMNESAKIIKETITELIRQEVISRTINIQSSVQSGIPILLNKQSRDLTQLIEKSCNRQELAQICENTIAIHHADGISPLDPHDFWRCPVGEPLLSNNPNISLLPGPSLLSGSTTISGCVRLPSLSIGDAIYAYSSNLITQGCADIGKSYQVLQLGYISLNSDMYPDLNPVISHTYDINDNRKSCSVIAAGTRGYQLCSLPTVNETTDYSSEGIEDLVFDILDLKGKTKSHRYKNEDITFDHPFSAMYPSVGSGIKIENTLIFLGYGGLTTPLQGDTKCVINRCTNVNQSVCNDALKITWLKKRQVVNVLIRINNYLSDRPKIVVETIPITQNYLGAEGRLLKLGKKIYIYTRSSGWHSNLQIGSLDINNPMTIKWAPHEVLSRPGNQDCNWYNRCPRECISGVYTDAYPLSPDAVNVATTTLYANTSRVNPTIMYSNTSEIINMLRLKNVQLEAAYTTTSCITHFGKGYCFHIVEINQASLNTLQPMLFKTSIPKICKITS

SEQ ID NO: 69 - protein, 240 aa, Human metapneumovirus
  MISC_FEATURE: attachment glycoprotein G
MEVRVENIRAIDMFKAKMKNRIRSSKCYRNATLILIGLTALSMALNIFLIIDYATLKNMTKVEHCVNMPPVEPSKKSPMTSAADLNTKLNPQQATQLTTEDSTSLAATSENHLHTETTPTSDATISQQATDEHTTLLRPINRQTTQTTTEKKPTGATTKKDKEKETTTRTTSTAATQTLNTTNQTSNGREATTTSARSRNGATTQNSDQTIQAADPSSKPYHTQTNTTTAHNTDTSSLSS

SEQ ID NO: 70 - protein, 604 aa, Hendra virus
  MISC_FEATURE: glycoprotein
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 71 - protein, 602 aa, Nipah virus
  MISC_FEATURE: attachment glycoprotein
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 72 - protein, 572 aa, Swine parainfluenza virus 3
  MISC_FEATURE: hemagglutinin-neuraminidase HN
MEYWKHTNSTKDTNNELGTTRDRHSSKATNIIMYIFWTTTSTILSVIFIMILINLIQENNHNKLMLQEIKKEFAVIDTKIQKTSDDISTSIQSGINTRLLTIQSHVQNYIPLSLTQQMSDLRKFINDLTTKREHQEVPIQRMTHDSGIEPLNPDKFWRCTSGNPSLTSSPKIRLIPGPGLLATSTTVNGCIRIPSLAINNLIYAYTSNLITQGCQDIGKSYQVLQIGIITINSDLVPDLNPRVTHTFNIDDNRKSCSLALLNTDVYQLCSTPKVDERSDYASTGIEDIVLDIVTSNGLIITTRFTNNNITFDKPYAALYPSVGPGIYYKDKVIFLGYGGLEHEENGDVICNTTGCPGKTQRDCNQASYSPWFSNRRMVNSIIVVDKSIDTTFSLRVWTIPMRQNYWGSEGRLLLLGDRIYIYTRSTSWHSKLQLGVIDISDYNNIRINWTWHNVLSRPGNDECPWGHSCPDGCITGVYTDAYPLNPSGSVVSSVILDSQKSRENPIITYSTATNRVNELAIYNRTLPAAYTTTNCITHYDKGYCFHIVEINHRSLNTFQPMLFKTEVPKNCS

SEQ ID NO: 73 - protein, 231 aa, Human metapneumovirus
  MISC_FEATURE: attachment glycoprotein G
MEVRVENIRAIDMFKAKIKNRIRSSRCYRNATLILIGLTALSMALNIFLIIDHATLRNMIKTENCANMPSAEPSKKTPMTSTAGPSTKPNPQQATQWTTENSTSPAATLEGHPYTGTTQTPDTTAPQQTTDKHTALPKSTNEQITQTTTEKKTTRATTQKREKRKENTNQTTSTAATQTTNTTNQTRNASETITTSDGPRIDTTTQSSEQTARATEPGSSPYHARRGAGPR

SEQ ID NO: 74 - protein, 595 aa, Feline morbillivirus
  MISC_FEATURE: hemagglutinin protein
MKNINIKYYKDSNRYLGKILDEHKIVNSQLYSLSIKVITIIAIIVSLIATIMTIINATSGRTTLNSNTDILLNQRDEIHSIHEMIFDRVYPLITAMSTELGLHIPTLLDELTKAIDQKIKIMNPPVDTVTSDLSWCIKPPNGIIIDPKGYCESMELSKTYKLLLDQLDVSRKKSLTINRKNINQCQLVDDSEIIFATVNIQSTPRFLNFGHTVSNQRITFGQGTYSSTYILTIQEDGITDVQYRVFEIGYISDQFGVFPSLIVSRVLPIRMVLGMESCTLTSDRQGGYFLCMNTLTRSIYDYVNIRDLKSLYITLPHYGKVNYTYFNFGKIRSPHEIDKLWLTSDRGQIISGYFAAFVTITIRNYNNYPYKCLNNPCFDNSENYCRGWYKNITGTDDVPILAYLLVEMYDEEGPLITLVAIPPYNYTAPSHNSLYYDDKINKLIMTTSHIGYIQINEVHEVIVGDNLKAILLNRLSDEHPNLTACRLNQGIKEQYKSDGMIISNSALIDIQERMYITVKAIPPVGNYNFTVELHSRSNTSYILLPKQFNAKYDKLHLECFNWDKSWWCALIPQFSLSWNESLSVDTAIFNLINCK

SEQ ID NO: 75 - protein, 613 aa, Avian paramyxovirus 6
  MISC_FEATURE: hemagglutinin-neuraminidase
MASPSELNRSQATLYEGDPNSKRTWRTVYRASTLILDLAILCVSIVAIVRMSTLTPSDVTDSISSSITSLSDTYQSVWSDTHQKVNSIFKEVGISIPVTLDKMQVEMGTAVNIITDAVRQLQGVNGSAGFSITNSPEYSGGIDALIYPQKSLNGKSLAISDLLEHPSFIPAPTTSHGCTRIPTFHLGYRHWCYSHNTIESGCHDAGESIMYLSMGAVGVGHQGKPVFTTSAAVILDDGKNRKSCSVVANPNGCDVLCSLVKQTEDQDYADPTPTPMIHGRLHFNGTYTESMLDQSLFTGHWVAQYPAVGSGSVSHGRLFFPLYGGISKSSSLFPKLRAHAYFTHNEELECKNLTSKQREDLFNAYMPGKIAGSLWAQGIVICNLTTLADCKIAVANTSTMMMAAEGRLQLVQDKVVLYQRSSSWWPVLIYYDILVSELVNARHLDIVNWVPYPQSKFPRPTWTKGLCEKPSICPAVCVTGVYQDVWVVSVGDFSNETVVIGGYLEAASERKDPWIAAANQYNWLTRRQLFTAQTEAAYSSTTCFRNTHQDKVFCLTIMEVTDNLLGDWRIAPLLYEVTVVDRQQSSRKAVAMSEAHRTRFKYYSPENKFTPQH

SEQ ID NO: 76 - protein, 564 aa, Fer-de-Lance paramyxovirus
  MISC_FEATURE: hemagglutinin-neuraminidase protein HN
MDPKSYYCNEDLRSDGGEKSPGGDLYKGIILVSTVISLIIAIISLAFIIDNKINIQSLDPLRGLEDSYLVPIKDKSESISQDIQEGIFPRLNLITAATTTTIPRSIAIQTKDLSDLIMNRCYPSVVNNDTSCDVLAGAIHSNLFSQLDPSTYWTCSSGTPTMNQTVKLLPDNSQIPGSTYSTGCVRIPTFSLGSMIYSYSHNVIYEGCNDHSKSSQYWQLGYISTSKTGEPLQQVSRTLTLNNGLNRKSCSTVAQGRGAYLLCTNVVEDERTDYSTEGIQDLTLDYIDIFGAERSYRYTNNEVDLDRPYAALYPSVGSGTVYNDRILFLGYGGLMTPYGDQAMCQAPECTSATQEGCNSNQLIGYFSGRQIVNCIIEIITVGTEKPIIRVRTIPNSQVWLGAEGRIQTLGGVLYLYIRSSGWHALAQTGIILTLDPIRISWIVNTGYSRPGNGPCSASSRCPAQCITGVYTDIFPLSQNYGYLATVTLLSGVDRVNPVISYGTSTGRVADSQLTSSSQVAAYTTTTCFTFNQKGYCYHIIELSPATLGIFQPVLVVTEIPKICS

SEQ ID NO: 77 - protein, 569 aa, Avian paramyxovirus 4
  MISC_FEATURE: hemagglutinin-neuraminidase
MQGNMEGSRDNLTVDDELKTTWRLAYRVVSLLLMVSALIISIVILTRDNSQSIITAINQSSDADSKWQTGIEGKITSIMTDTLDTRNAALLHIPLQLNTLEANLLSALGGNTGIGPGDLEHCRYPVHDTAYLHGVNRLLINQTADYTAEGPLDHVNFIPAPVTTTGCTRIPSFSVSSSIWCYTHNVIETGCNDHSGSNQYISMGVIKRAGNGLPYFSTVVSKYLTDGLNRKSCSVAAGSGHCYLLCSLVSEPEPDDYVSPDPTPMRLGVLTWDGSYTEQAVPERIFKNIWSANYPGVGSGAIVGNKVLFPFYGGVRNGSTPEVMNRGRYYYIQDPNDYCPDPLQDQILRAEQSYYPTRFGRRMVMQGVLACPVSNNSTIASQCQSYYFNNSLGFIGAESRIYYLNGNIYLYQRSSSWWPHPQIYLLDSRIASPGTQNIDSGVNLKMLNVTVITRPSSGFCNSQSRCPNDCLFGVYSDIWPLSLTSDSIFAFTMYLQGKTTRIDPAWALFSNHAIGHEARLFNKEVSAAYSTTTCFSDTIQNQVYCLSILEVRSELLGAFKIVPFLYRVL

SEQ ID NO: 78 - protein, 571 aa, Human parainfluenza virus 2
  MISC_FEATURE: hemagglutinin-neuraminidase protein
MEDYSNLSLKSIPKRTCRIIFRTATILGICTLIVLCSSILHEIIHLDVSSGLMDSDDSQQGIIQPIIESLKSLIALANQILYNVAIIIPLKIDSIETVIFSALKDMHTGSMSNTNCTPGNLLLHDAAYINGINKFLVLKSYNGTPKYGPLLNIPSFIPSATSPNGCTRIPSFSLIKTHWCYTHNVMLGDCLDFTTSNQYLAMGIIQQSAAAFPIFRTMKTIYLSDGINRKSCSVTAIPGGCVLYCYVATRSEKEDYATTDLAELRLAFYYYNDTFIERVISLPNTTGQWATINPAVGSGIYHLGFILFPVYGGLISGTPSYNKQSSRYFIPKHPNITCAGNSSEQAAAARSSYVIRYHSNRLIQSAVLICPLSDMHTARCNLVMFNNSQVMMGAEGRLYVIDNNLYYYQRSSSWWSASLFYRINTDFSKGIPPIIEAQWVPSYQVPRPGVMPCNATSFCPANCITGVYADVWPLNDPEPTSQNALNPNYRFAGAFLRNESNRTNPTFYTASASALLNTTGFNNTNHKAAYTSSTCFKNTGTQKIYCLIIIEMGSSLLGEFQIIPFLRELIP

SEQ ID NO: 79 - protein, 565 aa, Parainfluenza virus 5
  MISC_FEATURE: hemagglutinin-neuraminidase protein
MVAEDAPVRATCRVLFRTTTLIFLCTLLALSISILYESLITQKQIMSQAGSTGSNSGLGSITDLLNNILSVANQIIYNSAVALPLQLDTLESTLLTAIKSLQTSDKLEQNCSWSAALINDNRYINGINQFYFSIAEGRNLTLGPLLNMPSFIPTATTPEGCTRIPSFSLTKTHWCYTHNVILNGCQDHVSSNQFVSMGIIEPTSAGFPFFRTLKTLYLSDGVNRKSCSISTVPGGCMMYCFVSTQPERDDYFSAAPPEQRIIIMYYNDTIVERIINPPGVLDVWATLNPGTGSGVYYLGWVLFPIYGGVIKGTSLWNNQANKYFIPQMVAALCSQNQATQVQNAKSSYYSSWFGNRMIQSGILACPLRQDLTNECLVLPFSNDQVLMGAEGRLYMYGDSVYYYQRSNSWWPMTMLYKVTITFTNGQPSAISAQNVPTQQVPRPGTGDCSATNRCPGFCLTGVYADAWLLTNPSSTSTFGSEATFTGSYLNTATQRINPTMYIANNTQIISSQQFGSSGQEAAYGHTTCFRDTGSVMVYCIYIIELSSSLLGQFQIVPFIRQVTLS

SEQ ID NO: 80 - protein, 576 aa, Porcine rubulavirus
  MISC_FEATURE: attachment protein
MSQLGTDQIMHLAQPAIARRTWRLCFRIFALFILIAIVITQIFMLTFDHTLLTTTQFLTSIGNLQSTITSWTPDVQAMLSISNQLIYTTSITLPLKISTTEMSILTAIRDHCHCPDCSSACPTRQMLLNDPRYMSGVNQFIGAPTESINITFGPLFGIPSFIPTSTTTQGCTRIPSFALGPSHWCYTHNFITAGCADGGHSNQYLAMGTIQSASDGSPLLITARSYYLSDGVNRKSCSIAVVPGGCAMYCYVATRSETDYYAGNSPPQQLLTLVFSNDTIIERTIHPTGLANGWVMLVPGVGSGTLYNEYLLFPAYGGMQQILANQSGEINQFFTPYNATVRCAMAQPQFSQRAAASYYPRYFSNRWIRSAIVACPYRAIYQTQCTLIPLPNRMVMMGSEGRIFTLGDRLFYYQRSSSWWPYPLLYQVGLNFLTTPPSVSSMTQVPLEHLARPGKGGCPGNSHCPATCVTGVYADVWPLTDPRSGVGGTSLVAAGGLDSTSERMAPVNYLAIGESLLSKTYLLSKTQPAAYTTTTCFRDTDTGKIYCITIAELGKVLLGEFQIVPFLREIKIQSRY

SEQ ID NO: 81 - protein, 580 aa, Avian paramyxovirus 2
  MISC_FEATURE: hemagglutinin-neuraminidase
MDFPSRENLAAGDISGRKTWRLLFRILTLSIGVVCLAINIATIAKLDHLDNMASNTWTTTEADRVISSITTPLKVPVNQINDMFRIVALDLPLQMTSLQKEITSQVGFLAESINNVLSKNGSAGLVLVNDPEYAGGIAVSLYQGDASAGLNFQPISLIEHPSFVPGPTTAKGCIRIPTFHMGPSHWCYSHNIIASGCQDASHSSMYISLGVLKASQTGSPIFLTTASHLVDDNINRKSCSIVASKYGCDILCSIVIETENEDYRSDPATSMIIGRLFFNGSYTESKINTGSIFSLFSANYPAVGSGIVVGDEAAFPIYGGVKQNTWLFNQLKDFGYFTHNDVYKCNRTDIQQTILDAYRPPKISGRLWVQGILLCPVSLRPDPGCRLKVFNTSNVMMGAEARLIQVGSTVYLYQRSSSWWVVGLTYKLDVSEITSQTGNTLNHVDPIAHTKFPRPSFRRDACARPNICPAVCVSGVYQDIWPISTATNNSNIVWVGQYLEAFYSRKDPRIGIATQYEWKVTNQLFNSNTEGGYSTTTCFRNTKRDKAYCVVISEYADGVFGSYRIVPQLIEIRTTTGKSE

SEQ ID NO: 82 - protein, 236 aa, Human metapneumovirus
  MISC_FEATURE: attachment glycoprotein G
MEVKVENIRTIDMLKARVKNRVARSKCFKNASLILIGITTLSIALNIYLIINYTMQENTSESEHHTSSSPMESSRETPTVPIDNSDTNPSSQYPTQQSTEGSTLYFAASASSPETEPTSTPDTTSRPPFVDTHTTPPSASRTKTSPAVHTKNNPRISSRTHSPPWAMTRTVRRTTTLRTSSIRKRSSTASVQPDSSATTHKHEEASPVSPQTSASTTRPQRKSMEASTSTTYNQTS

SEQ ID NO: 83 - protein, 414 aa, Canine pneumovirus
  MISC_FEATURE: attachment protein
MRPAEQLIQENYKLTSLSMGRNFEVSGSTTNLNFERTQYPDTFRAVVKVNQMCKLIAGVLTSAAVAVCVGVIMYSVFTSNHKANSMQNATIRNSTSAPPQPTAGPPTTEQGTTPKFTKPPTKTTTHHEITEPAKMVTPSEDPYQCSSNGYLDRPDLPEDFKLVLDVICKPPGPEHHSTNCYEKREINLGSVCPDLVTMKANMGLNNGGGEEAAPYIEVITLSTYSNKRAMCVHNGCDQGFCFFLSGLSTDQKRAVLELGGQQAIMELHYDSYWKHYWSNSNCVVPRTNCNLTDQTVILFPSFNNKNQSQCTTCADSAGLDNKFYLTCDGLSRNLPLVGLPSLSPQAHKAALKQSTGTTTAPTPETRNPTPAPRRSKPLSRKKRALCGVDSSREPKPTMPYWCPMLQLFPRRSNS

SEQ ID NO: 84 - protein, 228 aa, Respiratory syncytial virus type A
  MISC_FEATURE: truncated attachment glycoprotein
MSKTKDQRAAKTLEKTWDTLNHLLFISSCLYKSNLKSIAQITLSILAMTIPTSLIIVATTFIASANNKVTPTTAIIQDATSQIKNTTPTHLTQNPQPGISFFNLSGTISQTTAILAPTTPSVEPILQSTTVKTKNTTTTQIQPSKLTTKQRQNKPPNKPNDDFHFEVFNFVPCSICSNNPTCWAICKRIPSKKPGKKTTTKPTKKQTIKTTKKDLKPQTTKPKEAPTT

SEQ ID NO: 85 - protein, 577 aa, Avian paramyxovirus 8
  MISC_FEATURE: hemagglutinin-neuraminidase protein
MSNIASSLENIVEQDSRKTTWRAIFRWSVLLITTGCLALSIVSIVQIGNLKIPSVGDLADEVVTPLKTTLSDTLRNPINQINDIFRIVALDIPLQVTSIQKDLASQFSMLIDSLNAIKLGNGTNLIIPTSDKEYAGGIGNPVFTVDAGGSIGFKQFSLIEHPSFIAGPTTTRGCTRIPTFHMSESHWCYSHNIIAAGCQDASASSMYISMGVLHVSSSGTPIFLTTASELIDDGVNRKSCSIVATQFGCDILCSIVIEKEGDDYWSDTPTPMRHGRFSFNGSFVETELPVSSMFSSFSANYPAVGSGEIVKDRILFPIYGGIKQTSPEFTELVKYGLFVSTPTTVCQSSWTYDQVKAAYRPDYISGRFWAQVILSCALDAVDLSSCIVKIMNSSTVMMAAEGRIIKIGIDYFYYQRSSSWWPLAFVTKLDPQELADTNSIWLTNSIPIPQSKFPRPSYSENYCTKPAVCPATCVTGVYSDIWPLTSSSSLPSIIWIGQYLDAPVGRTYPRFGIANQSHWYLQEDILPTSTASAYSTTTCFKNTARNRVFCVTIAEFADGLFGEYRITPQLYELVRNN

SEQ ID NO: 86 - protein, 576 aa, Porcine parainfluenza virus 1
  MISC_FEATURE: haemagglutinin protein
MEETKVKTSEYWARSPQIHATNHPNVQNREKIKEILTILISFISSLSLVLVIAVLIMQSLHNGTILRCKDVGLESINKSTYSISNAILDVIKQELITRIINTQSSVQVALPILINKKIQDLSLIIEKSSKVHQNSPTCSGVAALTHVEGIKPLDPDDYWRCPSGEPYLEDELTLSLIPGPSMLAGTSTIDGCVRLPSLAIGKSLYAYSSNLITKGCQDIGKSYQVLQLGIITLNSDLHPDLNPIISHTYDINDNRKSCSVAVSETKGYQLCSMPRVNEKTDYTSDGIEDIVFDVLDLKGSSRSFKFSNNDINFDHPFSALYPSVGSGIIWKNELYFLGYGALTTALQGNTKCNLMGCPGATQDNCNKFISSSWLYSKQMVNVLIQVKGYLSSKPSIIVRTIPITENYVGAEGKLVGTRERIYIYTRSTGWHTNLQIGVLNINHPITITWTDHRVLSRPGRSPCAWNNKCPRNCTTGVYTDAYPISPDANYVATVTLLSNSTRNNPTIMYSSSDRVYNMLRLRNTELEAAYTTTSCIVHFDRGYCFHIIEINQKELNTLQPMLFKTAIPKACRISNL

SEQ ID NO: 87 - protein, 579 aa, Human parainfluenza virus 4b
  MISC_FEATURE: hemagglutinin-neuraminidase protein
MQDSRGNTQIFSQANSMVKRTWRLLFRIVTLILLISIFVLSLIIVLQSTPGNLQSDVDIIRKELDELMENFETTSKSLLSVANQITYDVSVLTPIRQEATETNIIAKIKDHCKDRVVKGESTCTLGHKPLHDVSFLNGFNKFYFTYRDNVQIRLNPLLDYPNFIPTATTPHGCIRIPSFSLSQTHWCYTHNTILRGCEDTASSKQYVSLGTLQTLENGDPYFKVEYSHYLNDRKNRKSCSVVAVLDGCLLYCVIMTKNETENFKDPQLATQLLTYISYNGTIKERIINPPGSSRDWVHISPGVGSGILYSNYIIFPLYGGLMENSMIYNNQSGKYFFPNSTKLPCSNKTSEKITGAKDSYTITYFSKRLIQSAFLICDLRQFLSEDCEILIPSNDHMLVGAEGRLYNIENNIFYYQRGSSWWPYPSLYRIKLNSNKKYPRIIEIKFTKIEIAPRPGNKDCPGNKACPKECITGVYQDIWPLSYPNTAFPHKKRAYYTGFYLNNSLARRNPTFYTADNLDYHQQERLGKFNLTAGYSTTTCFKQTTTARLYCLYILEVGDSVIGDFQIFPFLRSIDQAIT

SEQ ID NO: 88 - protein, 582 aa, Avian paramyxovirus 2
  MISC_FEATURE: hemagglutinin-neuraminidase protein
MDALSRENLTEISQGGRRTWRMLFRILTLVLTLVCLAINIATIAKLDSIDTSKVQTWTTTESDRVIGSLTDTLKIPINQVNDMFRIVALDLPLQMTTLQKEIASQVGFLAESINNFLSKNGSAGSVLVNDPEYAGGIGTSLFHGDSASGLDFEAPSLIEHPSFIPGPTTAKGCIRIPTFHMSASHWCYSHNIIASGCQDAGHSSMYISMGVLKATQAGSPSFLTTASQLVDDKLNRKSCSIISTTYGCDILCSLVVENEDADYRSDPPTDMILGRLFFNGTYSESKLNTSAIFQLFSANYPAVGSGIVLGDEIAFPVYGGVKQNTWLFNQLKDYGYFAHNNVYKCNNSNIHQTVLNAYRPPKISGRLWSQVVLICPMRLFINTDCRIKVFNTSTVMMGAEARLIQVGSDIYLYQRSSSWWVVGLTYKLDFQELSSKTGNILNNVSPIAHAKFPRPSYSRDACARPNICPAVCVSGVYQDIWPISTAHNLSQVVWVGQYLEAFYARKDPWIGIATQYDWKKNVRLFNANTEGGYSTTTCFRNTKRDKAFCVIISEYADGVFGSYRIVPQLIEIRTTSKKGLPS

SEQ ID NO: 89 - protein, 610 aa, Avian paramyxovirus goose/Shimane/67/2000
  MISC_FEATURE: hemagglutinin-neuraminidase
MQPGISEVSFVNDERSERGTWRLLFRILTIVLCLTSIGIGIPALIYSKEAATSGDIDKSLEAVKTGMSTLSSKIDESINTEQKIYRQVILEAPVSQLNMESNILSAITSLSYQIDGTSNSSGCGSPMHDQDFVGGINKEIWTTDNVNLGEITLTPFLEHLNFIPAPTTGNGCTRIPSFDLGLTHWCYTHNVILSGCQDYSSSFQYIALGVLKISATGHVFLSTMRSINLDDERNRKSCSISATSIGCDIICSLVTEREVDDYNSPAATPMIHGRLDFSGKYNEVDLNVGQLFGDWSANYPGVGGGSFLNGRVWFPIYGGVKEGTPTFKENDGRYAIYTRYNDTCPDSESEQVSRAKSSYRPSYFGGKLVQQAVLSIKIDDTLGLDPVLTISNNSITLMGAESRVLQIEEKLYFYQRGTSWFPSLIMYPLTVDDKMVRFEPPTIFDQFTRPGNHPCSADSRCPNACVTGVYTDGYPIVFHNNHSIAAVYGMQLNDVTNRLNPRSAVWYGVSMSNVIRVSSSTTKAAYTTSTCFKVKKTQRVYCLSIGEIGNTLFGEFRIVPLLLEVYSEKGKSLKSSFDGWEDISINNPLRPLDNHRVDPILISNYTSSWP

SEQ ID NO: 90 - protein, 257 aa, Bovine respiratory syncytial virus
  MISC_FEATURE: attachment glycoprotein
MSNHTHHLKFKTLKRAWKASKYFIVGLSCLYKFNLKSLVQTALTTLAMITLTSLVITAIIYISVGNAKAKPTSKPTIQQTQQPQNHTSPFFTEHNYKSTHTSIQSTTLSQLPNTDTTRETTYSHSINETQNRKIKSQSTLPATRKPPINPSGSNPPENHQDHNNSQTLPYVPCSTCEGNLACLSLCQIGPERAPSRAPTITLKKTPKPKTTKKPTKTTIHHRTSPEAKLQPKNNTAAPQQGILSSPEHHTNQSTTQI

SEQ ID NO: 91 - protein, 595 aa, Menangle virus
  MISC_FEATURE: attachment protein
MWNSIPQLVSDHEEAKGKFTDIPLQDDTDSQHPSGSKSTCRTLFRTVSIILSLVILVLGVTSTMFSAKYSGGCATNSQLLGVSNLINQIQKSIDSLISEVNQVSITTAVTLPIKIMDFGKSVTDQVTQMIRQCNTVCKGPGQKPGSQNVRIMPSNNLSTFQNINMSARGIAYQDVPLTFVRPIKNPQSCSRFPSYSVSFGVHCFANAVTDQTCELNQNTFYRVVLSVSKGNISDPSSLETKAETRTPKGTPVRTCSIISSVYGCYLLCSKATVPESEEMKTIGFSQMFILYLSMDSKRIIYDNIVSSTSAIWSGLYPGEGAGIWHMGQLFFPLWGGIPFLTPLGQKILNSTLDIPEVGSKCKSDLTSNPAKTKDMLFSPYYGENVMVFGFLTCYLLSNVPTNCHADYLNSTVLGFGSKAQFYDYRGIVYMYIQSAGWYPFTQIFRITLQLKQNRLQAKSIKRIEVTSTTRPGNRECSVLRNCPYICATGLFQVPWIVNSDAITSKEVDNMVFVQAWAADFTEFRKGILSLCSQVSCPINDLLSKDNSYMRDTTTYCFPQTVPNILSCTSFVEWGGDSGNPINILEIHYEVIFVAS

SEQ ID NO: 92 - protein, 574 aa, Avian paramyxovirus 5
  MISC_FEATURE: hemagglutinin neuraminidase protein
MDKSYYTEPEDQRGNSRTWRLLFRLIVLTLLCLIACTSVSQLFYPWLPQVLSTLISLNSSIITSSNGLKKEILNQNIKEDLIYREVAINIPLTLDRVTVEVGTAVNQITDALRQLQSVNGSAAFALSNSPDYSGGIEHLVFQRNTLINRSVSVSDLIEHPSFIPTPTTQHGCTRIPTFHLGTRHWCYSHNIIGQGCADSGASMMYISMGALGVSSLGTPTFTTSATSILSDSLNRKSCSIVATTEGCDVLCSIVTQTEDQDYADHTPTPMIHGRLWFNGTYTERSLSQSLFLGTWAAQYPAVGSGIMTPGRVIFPFYGGVIPNSPLFLDLERFALFTHNGDLECRNLTQYQKEAIYSAYKPPKIRGSLWAQGFIVCSVGDMGNCSLKVINTSTVMMGAEGRLQLVGDSVMYYQRSSSWWPVGILYRLSLVDIIARDIQVVINSEPLPLSKFPRPTWTPGVCQKPNVCPAVCVTGVYQDLWAISAGETLSEMTFFGGYLEASTQRKDPWIGVANQYSWFMRRRLFKTSTEAAYSSSTCFRNTRLDRNFCLLIFELTDNLLGDWRIVPLLFELTIV

SEQ ID NO: 93 - protein, 622 aa, Cedar virus
  MISC_FEATURE: attachment glycoprotein
MLSQLQKNYLDNSNQQGDKMNNPDKKLSVNFNPLELDKGQKDLNKSYYVKNKNYNVSNLLNESLHDIKFCIYCIFSLLIIITIINIITISIVITRLKVHEENNGMESPNLQSIQDSLSSLTNMINTEITPRIGILVTATSVTLSSSINYVGTKTNQLVNELKDYITKSCGFKVPELKLHECNISCADPKISKSAMYSTNAYAELAGPPKIFCKSVSKDPDFRLKQIDYVIPVQQDRSICMNNPLLDISDGFFTYIHYEGINSCKKSDSFKVLLSHGEIVDRGDYRPSLYLLSSHYHPYSMQVINCVPVTCNQSSFVFCHISNNTKTLDNSDYSSDEYYITYFNGIDRPKTKKIPINNMTADNRYIHFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC

SEQ ID NO: 94 - protein, 595 aa, Teviot virus
  MISC_FEATURE: attachment protein
MWSTQASKHPAMVNSATNLVDIPLDHPSSAQFPINRKRTGRLIYRLFSILCNLILISILISLVVIWSRSSRDCAKSDGLSSVDNQLSSLSRSINSLITEVNQISVTTAINLPIKLSEFGKSVVDQVTQMIRQCNAACKGPGEKPGIQNVRINIPNNFSTYSELNRTANSLNFQSRTALFARPNPYPKTCSRFPSYSVYFGIHCFSHAVTDSSCELSDSTYYRLVIGVADKNLSDPADVKYIGETTTPVRVQTRGCSVVSSIYGCYLLCSKSNQDYQDDFREQGFHQMFILFLSRELKTTFFDDMVSSTTVTWNGLYPGEGSGIWHMGHLVFPLWGGIRFGTHASEGILNSTLELPPVGPSCKRSLADNGLINKDVLFSPYFGDSVMVFAYLSCYMLSNVPTHCQVETMNSSVLGFGSRAQFYDLKGIVYLYIQSAGWFSYTQLFRLSLQSKGYKLSVKQIKRIPISSTSRPGTEPCDIIHNCPYTCATGLFQAPWIVNGDSIRDRDVRNMAFVQAWSGAINTFQRPFMSICSQYSCPLSELLDSESSIMRSTTTYCFPSLTESILQCVSFIEWGGPVGNPISINEVYSSISFRPD

SEQ ID NO: 95 - protein, 632 aa, Mossman virus
  MISC_FEATURE: attachment glycoprotein
MVDPPAVSYYTGTGRNDRVKVVTTQSTNPYWAHNPNQGLRRLIDMVVNVIMVTGVIFALINIILGIVIISQSAGSRQDTSKSLDIIQHVDSSVAITKQIVMENLEPKIRSILDSVSFQIPKLLSSLLGPGKTDPPIALPTKASTPVIPTEYPSLNTTTCLRIEESVTQNAAALFNISFDLKTVMYELVTRTGGCVTLPSYSELYTRVRTFSTAIRNPKTCQRAGQETDLNLIPAFIGTDTGILINSCVRQPVIATGDGIYALTYLTMRGTCQDHRHAVRHFEIGLVRRDAWWDPVLTPIHHFTEPGTPVFDGCSLTVQNQTALALCTLTTDGPETDIHNGASLGLALVHFNIRGEFSKHKVDPRNIDTQNQGLHLVTTAGKSAVKKGILYSFGYMVTRSPEPGDSKCVTEECNQNNQEKCNAYSKTTLDPDKPRSMIIFQIDVGAEYFTVDKVVVVPRTQYYQLTSGDLFYTGEENDLLYQLHNKGWYNKPIRGRVTFDGQVTLHEHSRTYDSLSNQRACNPRLGCPSTCELTSMASYFPLDKDFKAAVGVIALRNGMTPIITYSTDDWRNHWKYIKNADLEFSESSLSCYSPNPPLDDYVLCTAVITAKVMSNTNPQLLATSWYQYDKCHT

SEQ ID NO: 96 - protein, 709 aa, J-virus
  MISC_FEATURE: attachment glycoprotein
MNPVAMSNFYGINQADHLREKGDQPEKGPSVLTYVSLITGLLSLFTIIALNVTNIIYLTGSGGTMATIKDNQQSMSGSMRDISGMLVEDLKPKTDLINSMVSYTIPSQISAMSAMIKNEVLRQCTPSFMFNNTICPIAEHPVHTSYFEEVGIEAISMCTGTNRKLVVNQGINFVEYPSFIPGSTKPGGCVRLPSFSLGLEVFAYAHAITQDDCTSSSTPDYYFSVGRIADHGTDVPVFETLAEWFLDDKMNRRSCSVTAAGKGGWLGCSILVGSFTDELTSPEVNRISLSYMDTFGKKKDWLYTGSEVRADQSWSALFFSVGSGVVIGDTVYFLVWGGLNHPINVDAMCRAPGCQSPTQSLCNYAIKPQEWGGNQIVNGILHFKHDTNEKPTLHVRTLSPDNNWMGAEGRLFHFHNSGKTFIYTRSSTWHTLPQVGILTLGWPLSVQWVDITSISRPGQSPCEYDNRCPHQCVTGVYTDLFPLGVSYEYSVTAYLDQVQSRMNPKIALVGAQEKIYEKTITTNTQHADYTTTSCFAYKLRVWCVSIVEMSPGVITTRQPVPFLYHLNLGCQDTSTGSLTPLDAHGGTYLNTDPVGNKVDCYFVLHEGQIYFGMSVGPINYTYSIVGRSREIGANMNVSLNQLCHSVYTEFLKEKEHPGTRNNIDVEGWLLKRIETLNGTKIFGLDDLEGSGPGHQSGPEDPSIAPIGHN

SEQ ID NO: 97 - protein, 264 aa, Avian metapneumovirus
  MISC_FEATURE: attachment glycoprotein
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPARPSSKSPTTTQATAQPTTPTAPKASTAPKNRQATTKKTETDTTTASRARNTNNPTETATTTPKATTETGKGKEGPTQHTTKEQPETTARETTTPQPRRTAGASPRAS

SEQ ID NO: 98 - protein, 391 aa, Avian metapneumovirus
  MISC_FEATURE: attachment protein
MGSKLYMVQGTSAYQTAVGFWLDIGRRYILAIVLSAFGLTCTVTIALTVSVIVEQSVLEECRNYNGGDRDWWSTTQEQPTTAPSATPAGNYGGLQTARTRKSESCLHVQISYGDMYSRSDTVLGGFDCMGLLVLCKSGPICQRDNQVDPTALCHCRVDLSSVDCCKVNKISTNSSTTSEPQKTNPAWPSQDNTDSDPNPQGITTSTATLLSTSLGLMLTSKTGTHKSGPPQALPGSNTNGKTTTDRELGSTNQPNSTTNGQHNKHTQRMTLPPSYDNTRTILQHTTPWEKTFSTYKPTHSPTNESDQSLPTTQNSINCEHFDPQGKEKICYRVGSYNSNITKQCRIDVPLCSTYNTVCMKTYYTEPFNCWRRIWRCLCDDGVGLVEWCCTS

SEQ ID NO: 99 - protein, 1052 aa, Tailam virus
  MISC_FEATURE: attachment glycoprotein
MSQLAAHNLAMSNFYGIHQGGQSTSQKEEEQPVQGVIRYASMIVGLLSLFTIIALNVTNIIYMTESGGTMQSIKNAQGSIDGSMKDLSGTIMEDIKPKTDLINSMVSYNIPAQLSMIHQIIKNDVLKQCTPSFMFNNTICPLAENPTHSRYFEEVNLDSISECSGNEMSLELGTEPEFIEYPSFAPGSTKPGSCVRLPSFSLSSTVFAYTHTIMGHGCSELDVGDHYLAIGRIADAGHEIPQFETISSWFINDKINRRSCTVAAGVMETWMGCVIMTETFYDDLDSLDTGKITISYLDVFGRKKEWIYTRSEILYDYTYTSVYFSIGSGVVVGDTVYFLLWGSLSSPIEETAYCYAPGCSNYNQRMCNEAQRPAKFGHRQMANAILRFKTNSMGKPSISVRTLSPTVIPFGTEGRLIYSDFTKIIYLYLRSTSWYVLPLTGLLILGPPVSISWVTQEAVSRPGEYPCGASNRCPKDCITGVYTDLFPLGARYEYAVTVYLNAETYRVNPTLALIDRSKIIARKKITTESQKAGYTTTTCFVFKLRIWCMSVVELAPATMTAFEPVPFLYQLDLTCKRNNGTTAMQFSGQDGMYKSGRYKSPRNECFFEKVSNKYYFVVSTPEGIQPYEVRDLTPERVSHVIMYISDVCAPALSAFKKLIPAMRPITTLTIGNWQFRPVDISGGLRVNIYRNLTRYGDLSMSAPEDPGTDTFPGTHAPSKGHEEVGHYTLPNEKLSEVTTAAVKTKESLNLIPDTKDTRGEEENGSGLNEIITGHTTPGHIKTHPAETKVTKHTVIIPQIEEDGSGATTSTELQDETGYHTEDYNTTNTNGSLTAPNERNNYTSGDHTVSGEDITHTITVSDRTKTTQTLPTDNTFNQTPTKIQEGSPKSESTPKDYTAIESEDSHFTDPTLIRSTPEGTIVQVIGDQFHSAVTQLGESNAIGNSEPIDQGNNLIPTTDRGTMDNTSSQSHSSTTSTQGSHSAGHGSQSNMNLTALADTDSVTDQSTSTQEIDHEHENVSSILNPLSRHTRVMRDTVQEALTGAWGFIRGMIP

SEQ ID NO: 100 - protein, 242 aa, Human metapneumovirus
  MISC_FEATURE: attachment glycoprotein G
MEVRVENIRAIDMFKAKIKNRIRNSRCYRNATLILIGLTALSMALNIFLIIDHATLRNMIKTENCANMPSAEPSKKTPMTSIAGPSTKPNPQQATQWTTENSTSPAATLEGHPYTGTTQTPDTTAPQQTTDKHTALPKSTNEQITQTTTEKKTTRATTQKRKKEKKTQTKPQVQLQPKQPTPPTKSEMQVRQSQHPTDPELTPLPKAVNRQPGQQNQAPHHIMHGEVQDPGERNTQVSHPSS

SEQ ID NO: 101 - protein, 585 aa, Avian metapneumovirus type C
  MISC_FEATURE: attachment glycoprotein
MEVKIENVGKSQELRVKVKNFIKRSDCKKKLFALILGLISFDITMNIMLSVMYVESNEALSSCRVQGTPAPRDNRTNTENTAKETTLHTMTTTRNTEAGGTKTTKPQADERATSPSKNPTIGADKHKTTRATTEAEQEKQSKQTTEPGTSTPKHIPARPSSKSPATTKTTTQPTTPTVAKGGTAPKNRQTTTKKTEADTPTTSRAKQTNKPTGTETTPPRATTETDKDKEGPTQHTTKEQPETTAGGTTTPQPRRTTSRPAPTTNTKEGAETTGTRTTKSTQTSASPPRPTRSTPSKTATGTNKRATTTKGPNTASTDRRQQTRTTPKQDQQTQTKAKTTTNKAHAKAATTPEHNTDTTDSMKENSKEDKTTRDPSSKATTKQENTSKGTTATNLGNNTEAGARTPPTTTPTRHTTEPATSTAGGHTKARTTRWKSTAARQPTRNNTTADTKTAQSKQTTPAQLGNNTTPENTTPPDNKSNSQTNVAPTEEIEIGSSLWRRRYVYGPCRENALEHPMNPCLKDNTTWIYLDNGRNLPAGYYDSKTDKIICYGIYRGNSYCYGRIECTCKNGTGLLSYCCNSYNWS

SEQ ID NO: 102 - protein, 609 aa, Rinderpest morbillivirus
  MISC_FEATURE: H protein
MSSPRDRVNAFYKDNLQFKNTRVVLNKEQLLIERPYMLLAVLFVMFLSLVGLLAIAGIRLHRAAVNTAEINSGLTTSIDITKSIEYQVKDVLTPLFKIIGDEVGLRTPQRFTDLTKFISDKIKFLNPDKEYDFRDINWCISPPERIKINYDQYCAHTAAEELITMLVNSSLAGTAVLRTSLVNLGRSCTGSTTTKGQFSNMSLALSGIYSGRGYNISSMITITEKGMYGSTYLVGKHNQGARRPSTAWQRDYRVFEVGIIRELGVGTPVFHMTNYLELPRQPELEICMLALGEFKLAALCLADNSVALHYGGLRDDHKIRFVKLGVWPSPADSDTLATLSAVDPTLDGLYITTHRGIIAAGKAVWAVPVTRTDDQRKMGQCRREACREKPPPFCNSTDWEPLEAGRIPAYGILTIRLGLADKPEIDIISEFGPLITHDSGMDLYTPLDGNEYWLTIPPLQNSALGTVNTLVLEPSLKISPNILTLPIRSGGGDCYTPTYLSDLADDDVKLSSNLVILPSRNLQYVSATYDTSRVEHAIVYYIYSTGRLSSYYYPVKLPIKGDPVSLQIGCFPWGLKLWCHHFCSVIDSGTGKQVTHTGAVGIEITCNSR

SEQ ID NO: 103 - protein, 575 aa, Avian paramyxovirus 10
  MISC_FEATURE: hemagglutinin-neuraminidase
MDSSQMNILDAMDRESSKRTWRGVFRVTTIIMVVTCVVLSAITLSKVAHPQGFDTNELGNGIVDRVSDKITEALTVPNNQIGEIFKIVALDLHVLVSSSQQAIAGQIGMLAESINSILSQNGSASTILSSSPEYAGGIGVPLFSNKLTNGTVIKPITLIEHPSFIPGPTTIGGCTRIPTFHMASSHWCYSHNIIEKGCKDSGISSMYISLGVLQVLKKGTPVFLVTASAVLSDDRNRKSCSIISSRFGCEILCSLVTEAESDDYKSDTPTGMVHGRLYFNGTYREGLVDTETIFRDFSANYPGVGSGEIVEGHIHFPIYGGVKQNTGLYNSLTPYWLDAKNKYDYCKLPYTNQTIQNSYKPPFIHGRFWAQGILSCELDLFNLGNCNLKIIRSDKVMMGAESRLMLVGSKLLMYQRASSWWPLGITQEIDIAELHSSNTTILREVKPILSSKFPRPSYQPNYCTKPSVCPAVCVTGVYTDMWPISITGNISDYAWISHYLDAPTSRQQPRIGIANQYFWIHQTTIFPTNTQSSYSTTTCFRNQVRSRMFCLSIAEFADGVFGEFRIVPLLYELRV

SEQ ID NO: 104 - protein, 593 aa, Tioman virus
  MISC_FEATURE: attachment protein
MWATSESKAPIPANSTLNLVDVPLDEPQTITKHRKQKRTGRLVFRLLSLVLSLMTVILVLVILASWSQKINACATKEGFNSLDLQISGLVKSINSLITEVNQISITTAINLPIKLSDFGKSIVDQVTQMIRQCNAVCKGPGEKPGIQNIRINIPNNFSTYLELNNTVKSIELQRRPALLARPNPIPKSCSRFPSYSVNFGIHCFAHAITDQSCELSDKTYYRLAIGISDKNLSDPSDVKYIGEAFTPMGLQARGCSVISSIYGCYLLCSKSNQGYEADFQTQGFHQMYILFLSRDLKTTLFNDMISSTTVVWNGLYPGEGAGIWHMGYLIFPLWGGIKIGTPASTSILNSTLDLPLVGPSCKSTLEENNLINKDVLFSPYFGESVMVFGFLSCYMLSNVPTHCQVEVLNSSVLGFGSRSQLMDLKGIVYLYIQSAGWYSYTQLFRLSLQSRGYKLTVKQIRRIPISSTTRPGTAPCDVVHNCPYTCATGLFQAPWIVNGDSILDRDVRNLVFVQAWSGNFNTFQKGLISICNQYTCPLTTLLDNDNSIMRSTTTYCYPSLSEYNLQCQSFIEWGGPVGNPIGILEVHYIIKFK

SEQ ID NO: 105 - protein, 604 aa, Dolphin morbillivirus
  MISC_FEATURE: haemagglutinin protein
MSSPRDKVDAFYKDIPRPRNNRVLLDNERVIIERPLILVGVLAVMFLSLVGLLAIAGVRLQKATTNSIEVNRKLSTNLETTVSIEHHVKDVLTPLFKIIGDEVGLRMPQKLTEIMQFISNKIKFLNPDREYDFNDLHWCVNPPDQVKIDYAQYCNHIAAEELIVTKFKELMNHSLDMSKGRIFPPKNCSGSVITRGQTIKPGLTLVNIYTTRNFEVSFMVTVISGGMYGKTYFLKPPEPDDPFEFQAFRIFEVGLVRDVGSREPVLQMTNFMVIDEDEGLNFCLLSVGELRLAAVCVRGRPVVTKDIGGYKDEPFKVVTLGIIGGGLSNQKTEIYPTIDSSIEKLYITSHRGIIRNSKARWSVPAIRSDDKDKMEKCTQALCKSRPPPSCNSSDWEPLTSNRIPAYAYIALEIKEDSGLELDITSNYGPLIIHGAGMDIYEGPSSNQDWLAIPPLSQSVLGVINKVDFTAGFDIKPHTLTTAVDYESGKCYVPVELSGAKDQDLKLESNLVVLPTKDFGYVTATYDTSRSEHAIVYYVYDTARSSSYFFPFRIKARGEPIYLRIECFPWSRQLWCHHYCMINSTVSNEIVVVDNLVSINMSCSR

SEQ ID NO: 106 - protein, 734 aa, Beilong virus
  MISC_FEATURE: attachment glycoprotein
MSQLAAHNLAMSNFYGTHQGDLSGSQKGEEQQVQGVIRYVSMIVSLLSLFTIIALNVTNIIYMTESGGTMQSIKTAQGSIDGSMREISGVIMEDVKPKTDLINSMVSYNIPAQLSMIHQIIKNDVPKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDRNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFAGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVNIGRNLTKEGDLTMSAPEDPGSNTFPGNHIPGNGILDAGYYTVEYPKE

SEQ ID NO: 107 - protein, 582 aa, Mapuera virus
  MISC_FEATURE: attachment protein
MASLQSEPGSQKPHYQSDDQLVKRTWRSFFRFSVLVVTITSLALSIITLIGVNRISTAKQISNAFAAIQANILSSIPDIRPINSLLNQLVYTSSVTLPLRISSLESNVLAAIQEACTYRDSQSSCSATMSVMNDQRYIEGIQVYSGSFLDLQKHTLSPPIAFPSFIPTSTTTVGCTRIPSFSLTKTHWCYTHNYIKTGCRDATQSNQYIALGTIYTDPDGTPGFSTSRSQYLNDGVNRKSCSISAVPMGCALYCFISVKEEVDYYKGTVPPAQTLILFFFNGTVHEHRIVPSSMNSEWVMLSPGVGSGVFYNNYIIFPLYGGMTKDKAEKRGELTRFFTPKNSRSLCKMNDSVFSNAAQSAYYPPYFSSRWIRSGLLACNWNQIITTNCEILTFSNQVMMMGAEGRLILINDDLFYYQRSTSWWPRPLVYKLDIELNYPDSHIQRVDQVEVTFPTRPGWGGCVGNNFCPMICVSGVYQDVWPVTNPVNTTDSRTLWVGGTLLSNTTRENPASVVTSGGSISQTVSWFNQTVPGAYSTTTCFNDQVQGRIFCLIIFEVGGGLLGEYQIVPFLKELKYQGAVHA

SEQ ID NO: 108 - protein, 657 aa, Nariva virus
  MISC_FEATURE: attachment protein
MAPINYPASYYTNNAERPVVITTKSTESKGQRPLPLGNARFWEYFGHVCGTLTFCMSLIGIIVGIIALANYSSDKDWKGRIGGDIQVTRMATEKTVKLILEDTTPKLRNILDSVLFQLPKMLASIASKINTQTPPPPTTSGHSTALATQCSSNCENRPEIGYDYLRQVEQSLQRITNISIQLLEASEIHSMAGAYPNALYKIRTQDSWSVTAKECPLQAFQPNLNLIPAMIGTATGALIRNCVRQPVIVVDDGVYMLTYLAMRGSCQDHQKSVRHFEMGVITSDPFGDPVPTPLRHWTKRALPAYDGCALAVKGHAGFALCTETSVGPLRDRTAKRKPNIVLFKASLVGELSERVIPPQSWLSGFSFFSVYTVAGKGYAYHSKFHAFGNVVRVGQSEYQAKCRGTGCPTANQDDCNTAQRVSQEDNTYLHQAILSVDIDSVIDPEDVVYVIERDQYYQASAGDLYRVPETGEILYNLHNGGWSNEVQVGRIQPSDRFYMREIQLTSTRVPAPNGCNRVKGCPGGCVAVISPAFTPMHPEFNVGVGIFPMNQPHNPSIMHVQQQTELFWKPIVGGNITLHESSIACYSTVPPNPSYDLCIGVMTLLLHQGQLPQFQALSWYQPTMCNGNAPQNRRALIPVIVEDSKAMSVSSDAPRTP

SEQ ID NO: 109 - protein, 632 aa, Bat Paramyxovirus Eid_hel/GH-M74a/GHA/2009
  MISC_FEATURE: glycoprotein
MPQKTVEFINMNSPLERGVSTLSDKKTLNQSKITKQGYFGLGSHSERNWKKQKNQNDHYMTVSTMILEILVVLGIMFNLIVLTMVYYQNDNINQRMAELTSNITVLNLNLNQLTNKIQREIIPRITLIDTATTITIPSAITYILATLTTRISELLPSINQKCEFKTPTLVLNDCRINCTPPLNPSDGVKMSSLATNLVAHGPSPCRNFSSVPTIYYYRIPGLYNRTALDERCILNPRLTISSTKFAYVHSEYDKNCTRGFKYYELMTFGEILEGPEKEPRMFSRSFYSPTNAVNYHSCTPIVTVNEGYFLCLECTSSDPLYKANLSNSTFHLVILRHNKDEKIVSMPSFNLSTDQEYVQIIPAEGGGTAESGNLYFPCIGRLLHKRVTHPLCKKSNCSRTDDESCLKSYYNQGSPQHQVVNCLIRIRNAQRDNPTWDVITVDLTNTYPGSRSRIFGSFSKPMLYQSSVSWHTLLQVAEITDLDKYQLDWLDTPYISRPGGSECPFGNYCPTVCWEGTYNDVYSLTPNNDLFVTVYLKSEQVAENPYFAIFSRDQILKEFPLDAWISSARTTTISCFMFNNEIWCIAALEITRLNDDIIRPIYYSFWLPTDCRTPYPHTGKMTRVPLRSTYNY

SEQ ID NO: 110 - protein, 569 aa, Avian paramyxovirus 7
  MISC_FEATURE: hemagglutinin-neuraminidase
MESIGKGTWRTVYRVLTILLDVVIIILSVIALISLGLKPGERIINEVNGSIHNQLVPLSGITSDIQAKVSSIYRSNLLSIPLQLDQINQAISSSARQIADTINSFLALNGSGTFIYTNSPEFANGFNRAMFPTLNQSLNMLTPGNLIEFTNFIPTPTTKSGCIRIPSFSMSSSHWCYTHNIIASGCQDHSTSSEYISMGVVEVTDQAYPNFRTTLSITLADNLNRKSCSIAATGFGCDILCSVVTETENDDYQSPEPTQMIYGRLFFNGTYSEMSLNVNQMFADWVANYPAVGSGVELADFVIFPLYGGVKITSTLGASLSQYYYIPKVPTVNCSETDAQQIEKAKASYSPPKVAPNIWAQAVVRCNKSVNLANSCEILTFNTSTMMMGAEGRLLMIGKNVYFYQRSSSYWPVGIIYKLDLQELTTFSSNQLLSTIPIPFEKFPRPASTAGVCSKPNVCPAVCQTGVYQDLWVLYDLGKLENTTAVGLYLNSAVGRMNPFIGIANTLSWYNTTRLFAQGTPASYSTTTCFKNTKIDTAYCLSILELSDSLLGSWRITPLLYNITLSIMS

SEQ ID NO: 111 - protein, 588 aa, Tuhoko virus 2
  MISC_FEATURE: hemagglutinin-neuraminidase
MPPVPTVSQSIDEGSFTDIPLSPDDIKHPLSKKTCRKLFRIVTLIGVGLISILTIISLAQQTGILRKVDSSDFQSYVQESFKQVLNLMKQFSSNLNSLIEITSVTLPFRIDQFGTDIKTQVAQLVRQCNAVCRGPIKGPTTQNIVYPALYETSLNKTLETKNVRIQEVRQEVDPVPGPGLSNGCTRNPSFSVYHGVWCYTHATSIGNCNGSLGTSQLFRIGNVLEGDGGAPYHKSLATHLLTTRNVSRQCSATASYYGCYFICSEPVLTERDDYETPGIEPITIFRLDPDGNWVVFPNINRFTEYSLKALYPGIGSGVLFQGKLIFPMYGGIDKERLSALGLGNIGLIERRMADTCNHTEKELGRSFPGAFSSPYYHDAVMLNFLLICEMIENLPGDCDLQILNPTNMSMGSESQLSVLDNELFLYQRSASWWPYTLIYRLNMRYTGKYLKPKSIIPMVIKSNTRPGYEGCNHERVCPKVCVTGVFQAPWILSIGRDHKERVSNVTYMVAWSMDKSDRTYPAVSVCGSDTCKLTVPLGDSKVHSAYSVTRCYLSRDHMSAYCLVIFELDARPWAEMRIQSFLYKLILT

SEQ ID NO: 112 - protein, 582 aa, Tuhoko virus 3
  MISC_FEATURE: hemagglutinin-neuraminidase
MHNRTQSVSSIDTSSDVYLPRRKKAVTKFTFKKIFRVLILTLLLSIIIIIAVIFPKIDHIRETCDNSQILETITNQNSEIKNLINSAITNLNVLLTSTTVDLPIKLNNFGKSIVDQVTMMVRQCNAVCRGPGDRPTQNIELFKGLYHTSPPSNTSTKLSMITEASNPDDIVPRPGKLLGCTRFPSFSVHYGLWCYGHMASTGNCSGSSPSVQIIRIGSIGTNKDGTPKYVIIASASLPETTRLYHCSVTMTSIGCYILCTTPSVSETDDYSTMGIEKMSISFLSLDGYLTQLGQPTGLDNQNLYALYPGPGSGVIFRDFLIFPMMGGIRLMDAQKMLNRNITYRGFPPSETCTESELKLKQEVANMLTSPYYGEVLVLNFLYVCSLLDNIPGDCSVQLIPPDNMTLGAESRLYVLNGSLIMYKRGSSWWPYTELYQINYRVNNRAFRVRESVRINTTSTSRPGVQGCNLEKVCPKVCVSGIYQSPGIISAPVNPTRQEEGLLYFLVWTSSMSSRTGPLSSLCDHSTCRITYPIGDDTIFIGYTDSSCFMSSIKEGIYCIAFLELDNQPYSMMAIRSLSYIIN

SEQ ID NO: 113 - protein, 625 aa, Mojiang virus
  MISC_FEATURE: attachment glycoprotein
MATNRDNTITSAEVSQEDKVKKYYGVETAEKVADSISGNKVFILMNTLLILTGAIITITLNITNLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKPDDDTTDDDKVDTTIKPIEYPKPDGCNRTGDHFTMEPGANFYTVPNLGPASSNSDECYTNPSFSIGSSIYMFSQEIRKTDCTAGEILSIQIVLGRIVDKGQQGPQASPLLVWAVPNPKIINSCAVAAGDEMGWVLCSVTLTAASGEPIPHMFDGFWLYKLEPDTEVVSYRITGYAYLLDKQYDSVFIGKGGGIQKGNDLYFQMYGLSRNRQSFKALCEHGSCLGTGGGGYQVLCDRAVMSFGSEESLITNAYLKVNDLASGKPVIIGQTFPPSDSYKGSNGRMYTIGDKYGLYLAPSSWNRYLRFGITPDISVRSTTWLKSQDPIMKILSTCTNTDRDMCPEICNTRGYQDIFPLSEDSEYYTYIGITPNNGGTKNFVAVRDSDGHIASIDILQNYYSITSATISCFMYKDEIWCIAITEGKKQKDNPQRIYAHSYKIRQMCYNMKSATVTVGNAKNITIRRY

SEQ ID NO: 114 - protein, 614 aa, Avian paramyxovirus 12
  MISC_FEATURE: hemagglutinin-neuraminidase
MESATSQVSFENDKTSDRRTWRAVFRVLMIILALSSLCVTVAALIYSAKAAIPGNIDASEQRILSSVEAVQVPVSRLEDTSQKIYRQVILEAPVTQLNMETNILNAITSLSYQIDASANSSGCGAPVHDSDFTGGVGRELLQEAEVNLTIIRPSKFLEHLNFIPAPTTGNGCTRIPSFDLGQTHWCYTHNVVLNGCRDRGHSFQYVALGILRTSATGSVFLSTLRSVNLDDDRNRKSCSVSATPIGCEMLCSLVTETEEGDYDSIDPTPMVHGRLGFDGKYREVDLSEKEIFADWRANYPAVGGGAFFGNRVWFPVYGGLKEGTQSERDAEKGYAIYKRFNNTCPDDNTTQIANAKASYRPSRFGGRFIQQGILSFKVEGNLGSDPILSLTDNSITLMGAEARVMNIENKLYLYQRGTSWFPSALVYPLDVANTAVKVRAPYIFDKFTRPGGHPCSASSRCPNVCVTGVYTDAYPLVFSRSHDIVAVYGMQLAAGTARLDPQAAIWYGNEMSTPTKVSSSTTKAAYTTSTCFKVTKTKRIYCISIAEIGNTLFGEFRIVPLLIEVQKTPLTRRSELRQQMPQPPIDLVIDNPFCAPSGNLSRKNAIDEYANSWP

SEQ ID NO: 115 - protein, 577 aa, Avian paramyxovirus 3
  MISC_FEATURE: hemagglutinin
MEPTGSKVDIVPSQGTKRTCRTFYRLLILILNLIIIILTIISIYVSISTDQHKLCNNEADSLLHSIVEPITVPLGTDSDVEDELREIRRDTGINIPIQIDNTENIILTTLASINSNIARLHNATDESPTCLSPVNDPRFIAGINKITKGSMIYRNFSNLIEHVNFIPSPTTLSGCTRIPSFSLSKTHWCYSHNVISTGCQDHAASSQYISIGIVDTGLNNEPYLRTMSSRLLNDGLNRKSCSVTAGAGVCWLLCSVVTESESADYRSRAPTAMILGRFNFYGDYTESPVPASLFSGRFTANYPGVGSGTQLNGTLYFPIYGGVVNDSDIELSNRGKSFRPRNPTNPCPDPEVTQSQRAQASYYPTRFGRLLIQQAILACRISDTTCTDYYLLYFDNNQVMMGAEARIYYLNNQMYLYQRSSSWWPHPLFYRFSLPHCEPMSVCMITDTHLILTYATSRPGTSICTGASRCPNNCVDGVYTDVWPLTEGTTQDPDSYYTVFLNSPNRRISPTISIYSYNQKISSRLAVGSEIGAAYTTSTCFSRTDTGALYCITIIEAVNTIFGQYRIVPILVQLISD

SEQ ID NO: 116 - protein, 620 aa, Salem virus
  MISC_FEATURE: attachment glycoprotein
MKAMHYYKNDFADPGTNDNSSDLTTNPFISNQIKSNLSPPVLAEGHLSPSPIPKFRKILLTISFVSTIVVLTVILLVLTIRILTIIEASAGDEKDIHTILSSLLNTFMNEYIPVFKNLVSIISLQIPQMLIDLKTSSTQMMQSLKTFPRDLETLSTVTQSVAVLLEKAKSTIPDINKFYKNVGKVTFNDPNIKVLTLEVPAWLPIVRQCLKQDFRQVISNSTGFALIGALPSQLFNEFEGYPSLAIVSEVYAITYLKGVMFENQENFLYQYFEIGTISPDGYNKPYFLRHTSVMLSTFKLSGKCTAAVDYRGGIFLCTPSPKIPKILQNPPDLPTLTVVSIPFDGRYTIRNISLMLTDEADIIYDLDTLQGRGVLQAMRFYALVRVISSSSPRHFPFCKNSWCPTADDKICDQSRRLGADGNYPVMYGLISIPAHSSYQGNVSLKLIDPKYYAYTRDASLFYNSMTDTYHYSFGTRGWVSRPIIGELLLGDDIVLTRYTVRSVSRATAGDCTTVSMCPQACSGGMNSIFYPLNFDKPQVTGVAIRQYERQQEGIIVVTMNDHYYYSVPIIKNGTLLISSVTDCFWLMGDLWCMSLMEKNNLPLGVRSLAHLTWNIHWSCS

SEQ ID NO: 117 - protein, 579 aa, Avian paramyxovirus 9
  MISC_FEATURE: hemagglutinin-neuraminidase
MESGISQASLVNDNIELRNTWRTAFRVVSLLLGFTSLVLTACALHFALNAATPADLSSIPVAVDQSHHEILQTLSLMSDIGNKIYKQVALDSPVALLNTESTLMSAITSLSYQINNAANNSGCGAPVHDKDFINGVAKELFVGSQYNASNYRPSRFLEHLNFIPAPTTGKGCTRIPSFDLAATHWCYTHNVILNGCNDHAQSYQYISLGILKVSATGNVFLSTLRSINLDDDENRKSCSISATPLGCDLLCAKVTEREEADYNSDAATRLVHGRLGFDGVYHEQALPVESLFSDWVANYPSVGGGSYFDNRVWFGVYGGIRPGSQTDLLQSEKYAIYRRYNNTCPDNNPTQIERAKSSYRPQRFGQRLVQQAILSIRVEPSLGNDPKLSVLDNTVVLMGAEARIMTFGHVALMYQRGSSYFPSALLYPLSLTNGSAAASKPFIFEQYTRPGSPPCQATARCPNSCVTGVYTDAYPLFWSEDHKVNGVYGMMLDDITSRLNPVAAIFDRYGRSRVTRVSSSSTKAAYTTNTCFKVVKTKRVYCLSIAEIENTLFGEFRITPLLSEIIFDPNLEPSDTSRN

SEQ ID NO: 118 - protein, 595 aa, Achimota virus 1
  MISC_FEATURE: attachment protein
MATNLSTITNGKFSQNSDEGSLTELPFFEHNRKVATTKRTCRFVFRSVITLCNLTILIVTVVVLFQQAGFIKRTESNQVCETLQNDMHGVVTMSKGVITTLNNLIEITSVNLPFQMKQFGQGIVTQVTQMVRQCNAVCKGPTIGPDIQNIVYPASYESMIKHPVNNSNILLSEIRQPLNFVPNTGKLNGCTRTPSFSVYNGFWCYTHAESDWNCNGSSPYMQVFRVGVVTSDYDYNVIHKTLHTKTSRLANVTYQCSTISTGYECYFLCSTPNVDEITDYKTPGIESLQIYKIDNRGTFAKFPITDQLNKELLTALYPGPGNGVLYQGRLLFPMHGGMQSSELNKVNLNNTVLSQFNDNKGCNATEIKLESEFPGTFTSPYYSNQVMLNYILICEMIENLPGNCDLQIVAPKNMSMGSESQLYSINNKLYLYQRSSSRWPYPLIYEVGTRLTNRQFRLRAINRFLIKSTTRPGSEGCNIYRVCPKVCVTGVYQAPWILHVSKAGSQSIAKVLYAVAWSKDHMSRKGPLFSICDNDTCFLTKSLASEHVHSGYSITRCYLENSERHIICVVIMELDASPWAEMRIQSVIYNITLPS

SEQ ID NO: 119 - protein, 583 aa, Achimota virus 2
  MISC_FEATURE: attachment protein
MDNSMSISTISLDAQPRIWSRHESRRTWRNIFRITSLVLLGVTVIICIWLCCEVARESELELLASPLGALIMAINTIKSSVVKMTTELNQVTFTTSIILPNKVDQFGQNVVSQVAQLVKQCNAVCRGHQDTPELEQFINQKNPTWILQPNYTTKLTNLHEIDSIIPLVDYPGFSKSCTRFPSFSEGSKFWCFTYAVVKEPCSDISSSIQVVKYGAIKANHSDGNPYLVLGTKVLDDGKFRRGCSITSSLYGCYLLCSTANVSEVNDYAHTPAYPLTLELISKDGITTDLSPTYTVQLDKWSALYPGIGSGVIFKGYLMFPVYGGLPFKSPLISASWVGPGNKWPVDFSCSEDQYSTFNFSNPYSALYSPHFSNNIVVSALFVCPLNENLPYSCEVQVLPQGNLTIGAEGRLYVIDQDLYYYQRSTSWWPYLQLYKLNIRITNRVFRVRSLSLLPIKSTTRPGYGNCTYFKLCPHICVTGVYQSPWLISIRDKRPHEEKNILYFIGWSPDEQIRQNPLVSLCHETACFINRSLATNKTHAGYSESHCVQSFERNKLTCTVFYELTAKPWAEMRVQSLLFQVDFL

SEQ ID NO: 120 - protein, 580 aa, Tuhoko virus 1
  MISC_FEATURE: hemagglutinin-neuraminidase
MDSRSDSFTDIPLDNRIERTVTSKKTWRSIFRVTAIILLIICVVVSSISLNQHNDAPLNGAGNQATSGFMDAIKSLEKLMSQTINELNQVVMTTSVQLPNRITKFGQDILDQVTQMVRQCNAVCRGPGVGPSIQNYVIQGHAPTVSFDPISAEYQKFVFGITEKTLITAYHNPWECLRFPSQHLFDTTWCVSYQILTQNCSDHGPRITVIQLGEIMIANNLSTVFRDPVIKYIRHHIWLRSCSVVAYYSQCTIFCTSTNKSEPSDYADTGYEQLFLATLQSDGTFTEHSMHGVNIVHQWNAIYGGVGNGVIIGRNMLIPLYGGINYYDHNTTIVQTVDLRPYPIPDSCSQTDNYQTNYLPSMFTNSYYGTNLVVSGYLSCRLMAGTPTSCSIRVIPIENMTMGSEGQFYLINNQLYYYKRSSNWIRDTQVYLLSYSDKGNIIEITSAERYIFKSVTSPDEGDCVTNHGCPSNCIGGLFQAPWILNDFKLCGSNITCPKIVTVWADQPDKRSNPMLSIAETDKLLLHKSYINYHTAVGYSTVLCFDSPKLNLKTCVVLQELMSDDKLLIRISYSIVSIMVE

SEQ ID NO: 121 - protein, 607 aa, Phocine distemper virus
  MISC_FEATURE: hemagglutinin protein
MFSHQDKVGAFYKNNARANSSKLSLVTDEVEERRSPWFLSILLILLVGILILLAITGIRFHQVVKSNLEFNKLLIEDMEKTKAVHHQVKDVLTPLFKIIGDEVGLRLPQKLNEIKQFIVQKTNFFNPNREFDFRELHWCINPPSKVKVNFTQYCEITEFKEATRSVANSILLLTLYRGRDDIFPPYKCRGATTSMGNVFPLAVSLSMSLISKPSEVINMLTAISEGIYGKTYLLVTDDTEENFETPEIRVFEIGFINRWLGDMPLFQTTNYRIISNNSNTKICTIAVGELALASLCTKESTILLNLGDEESQNSVLVVILGLFGATHMDQLEEVIPVAHPSIEKIHITNHRGFIKDSVATWMVPALALSEQGEQINCLRSACKRRTYPMCNQTSWEPFGDKRLPSYGRLTLSLDVSTDLSINVSVAQGPIIFNGDGMDYYEGTLLNSGWLTIPPKNGTILGLINQASKGDQFIVTPHILTFAPRESSTDCHLPIQTYQIQDDDVLLESNLVVLPTQSFEYVVATYDVSRSDHAIVYYVYDPARTVSYTYPFRLRTKGRPDILRIECFVWDGHLWCHQFYRFQLDATNSTSVVENLIRIRFSCDRLDP

SEQ ID NO: 122 - protein, 574 aa, Caprine parainfluenza virus 3
  MISC_FEATURE: hemagglutinin-neuraminidase
MEYWGHTNNPDKINRKVGVDQVRDRSKTLKIITFIISMMTSIMSTVALILILIMFIQNNNNNRIILQELRDETDAIEARIQKASNDIGVSIQSGINTRLLTIQNHVQNYIPLALTQQVSSLRESINDVITKREETQSKMPIQRMTHDDGIEPLIPDNFWKCPSGIPTISASPKIRLIPGPGLLATSTTINGCIRLPSLVINNLIYAYTSNLITQGCQDIGKSYQVLQIGIITINSDLVPDLNPRITHTFDIDDNRKSCSLALRNADVYQLCSTPKVDERSDYSSIGIEDIVLDIVTSEGTVSTTRFTNNNITFDKPYAALYPSVGPGIYYDNKIIFLGYGGLEHEENGDVICNITGCPGKTQHDCNQASYSPWFSNRRMVNAIILVNKGLNKVPSLQVWTIPMRQNYWGSEGRLLLLGNKIYIYTRSTSWHSKLQLGTLDISNYNDIRIRWTHHDVLSRPGSEECPWGNTCPRGCITGVYNDAYPLNPSGSVVSSVILDSRTSRENPIITYSTDTSRVNELAIRNNTLSAAYTTTNCVTHYGKGYCFHIIEINHKSLNTLQPMLFKTEIPKSCN

SEQ ID NO: 123 - protein, 414 aa, Avian metapneumovirus
  MISC_FEATURE: attachment glycoprotein
MGSELYIIEGVSSSEIVLKQVLRRSKKILLGLVLSALGLTLTSTIVISICISVEQVKLRQCVDTYWAENGSLHPGQSTENTSTRGKTTTKDPRRLQATGAGKFESCGYVQVVDGDMHDRSYAVLGGVDCLGLLALCESGPICQGDTWSEDGNFCRCTFSSHGVSCCKKPKSKATTAQRNSKPANSKSTPPVHSDRASKEHNPSQGEQPRRGPTSSKTTIASTPSTEDTAKPTISKPKLTIRPSQRGPSGSTKAASSTPSHKTNTRGTSKTTDQRPRTGPTPERPRQTHSTATPPPTTPIHKGRAPTPKPTTDLKVNPREGSTSPTAIQKNPTTQSNLVDCTLSDPDEPQRICYQVGTYNPSQSGTCNIEVPKCSTYGHACMATLYDTPFNCWRRTRRCICDSGGELIEWCCTSQ

SEQ ID NO: 124 - protein, 665 aa, Tupaia paramyxovirus
  MISC_FEATURE: hemagglutinin
MDYHSHTTQTGSNETLYQDPLQSQSGSRDTLDGPPSTLQHYSNPPPYSEEDQGIDGPQRSQPLSTPHQYDRYYGVNIQHTRVYNHLGTIYKGLKLAFQILGWVSVIITMIITVTTLKKMSDGNSQDSAMLKSLDENFDAIQEVANLLDNEVRPKLGVTMTQTTFQLPKELSEIKRYLLRLERNCPVCGTEATPQGSKGNASGDTAFCPPCLTRQCSEDSTHDQGPGVEGTSRNHKGKINFPHILQSDDCGRSDNLIVYSINLVPGLSFIQLPSGTKHCIIDVSYTFSDTLAGYLIVGGVDGCQLHNKAIIYLSLGYYKTKMIYPPDYIAIATYTYDLVPNLRDCSIAVNQTSLAAICTSKKTKENQDFSTSGVHPFYIFTLNTDGIFTVTVIEQSQLKLDYQYAALYPATGPGIFIGDHLVFLMWGGLMTKAEGDAYCQASGCNDAHRTSCNIAQMPSAYGHRQLVNGLLMLPIKELGSHLIQPSLETISPKINWAGGHGRLYYNWEINTTYIYIEGKTWRSRPNLGIISWSKPLSIRWIDHSVARRPGARPCDSANDCPEDCLVGGYYDMFPMSSDYKTAITIIPTHHQWPSSPALKLFNTNREVRVVMILRPPNNVKKTTISCIRIMQTNWCLGFIIFKEGNNAWGQIYSYIYQVESTCPNTK

SEQ ID NO: 125 - protein, 585 aa, Avian metapneumovirus
  MISC_FEATURE: attachment glycoprotein
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPTRPSSKSPTTTQAIAQLTTPTTPKASTAPKNRQATTKKTETDTTTASRARNTNNPTETATTTPKATTETGKSKEGPTQHTTKEQPETTAGETTTPQPRRTASRPAPTTKIEEEAETTKTRTTKSTQTSTGPPRPTGGAPSGAATEGSGRAAAAGGPSAASAGGRRRTEAAAERDRRTRAGAGPTAGGARARTAAASERGADTAGSAGGGPGGDGATGGLSGGAPAEREDASGGTAAAGPGDGTEADGRAPPAAALAGRTTESAAGAAGDSGRAGTAGWGSAADGRSTGGNAAAEAGAAQSGRAAPRQPSGGTAPESTAPPNSGGSGRADAAPTEEVGVGSGLWRGRYVCGPCGESVPEHPMNPCFGDGTAWICSDDGGSLPAGCYDGGTDGVVCCGVCGGNSCCCGRVECTCGGGAGLLSCCCGSYSWS

SEQ ID NO: 126 - protein, 577 aa, Avian paramyxovirus 3
  MISC_FEATURE: hemagglutinin-neuraminidase protein
MESPPSGKDAPAFREPKRTCRLCYRATTLSLNLTIVVLSIISIYVSTQTGANNSCVNPTIVTPDYLTGSTTGSVEDLADLESQLREIRRDTGINLPVQIDNTENLILTTLASINSNLRFLQNATTESQTCLSPVNDPRFVAGINRIPAGSMAYNDFSNLIEHVNFIPSPTTLSGCTRIPSFSLSKTHWCYTHNVISNGCLDHAASSQYISIGIVDTGLNNEPYFRTMSSKSLNDGLNRKSCSVTAAANACWLLCSVVTEYEAADYRSRTPTAMVLGRFDFNGEYTEIAVPSSLFDGRFASNYPGVGSGTQVNGTLYFPLYGGVLNGSDIETANKGKSFRPQNPKNRCPDSEAIQSFRAQDSYYPTRFGKVLIQQAIIACRISNKSCTDFYLLYFDNNRVMMGAEARLYYLNNQLYLYQRSSSWWPHPLFYSISLPSCQALAVCQITEAHLTLTYATSRPGMSICTGASRCPNNCVDGVYTDVWPLTKNDAQDPNLFYTVYLNNSTRRISPTISLYTYDRRIKSKLAVGSDIGAAYTTSTCFGRSDTGAVYCLTIMETVNTIFGQYRIVPILLRVTSR

SEQ ID NO: 127 - protein, 585 aa, Avian metapneumovirus
  MISC_FEATURE: attachment glycoprotein
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPARPSSKSPTTTQATAQPTTPTAPKASTAPKNRQATTKKTETDTTTASRARNTNNPTETATTTPKATTETGKGKEGPTQHTTKEQPETTARETTTPQPRRTASRPAPTTKIEEEAETTKTRTTKNTQTSTGPPRPTRSTPSKTATENNKRTTTTKRPNTASTDSRQQTRTTAEQDQQTQTRAKPTTNGAHPQTTTTPEHNTDTTNSTKGSPKEDKTTRDPSSKTPTEQEDASKGTAAANPGGSAEADRRAPPATTPTGRTTESAAGTTGDDSGAETTRRRSAADRRPTGGSTAAEAGTAQSGRATPKQPSGGTAAGNTAPPNNESSGRADAAPAEEAGVGPSIRRGRHACGPRRESAPEHPTNPCPGDGTAWTRSDGGGNLPAGRHDSGADGAARRGARGGNPRRRGRAERTRGGGAGPPSCRCGSHNRS

SEQ ID NO: 128 - protein, 389 aa, Avian metapneumovirus type D
  MISC_FEATURE: attachment glycoprotein
MGAKLYAISGASDAQLMKKTCAKLLEKVVPIIILAVLGITGTTTIALSISISIERAVLSDCTTQLRNGTTSGSLSNPTRSTTSTAVTTRDIRGLQTTRTRELKSCSNVQIAYGYLHDSSNPVLDSIGCLGLLALCESGPFCQRNYNPRDRPKCRCTLRGKDISCCKEPPTAVTTSKTTPWGTEVHPTYPTQVTPQSQPATMAHQTATANQRSSTTEPVGSQGNTTSSNPEQQTEPPPSPQHPPTTTSQDQSTETADGQEHTPTRKTPTATSNRRSPTPKRQETGRATPRNTATTQSGSSPPHSSPPGVDANMEGQCKELQAPKPNSVCKGLDIYREALPRGCDKVLPLCKTSTIMCVDAYYSKPPICFGYNQRCFCMETFGPIEFCCKS

SEQ ID NO: 129 - protein, 197 aa, Respiratory syncytial virus
MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSEIHHTTAQTKGRTSTPTQNNKPNTKPRPKNPPKKDDYHFEVFNFVPCSICGNNQLCKSICKTIPSNKPRKNQP

SEQ ID NO: 130 - protein, 580 aa, Avian paramyxovirus 14
  MISC_FEATURE: hemagglutinin-neuraminidase protein
MEGSRTVIYQGDPNEKNTWRLVFRTLTLILNLAILSVTIASIIITSKITLSEVTTLKTEGVEEVITPLMATLSDSVQQEKMIYKEVAISIPLVLDKIQTDVGTSVAQITDALRQIQGVNGTQAFALSNAPEYSGGIEVPLFQIDSFVNKSMSISGLLEHASFIPSPTTLHGCTRIPSFHLGPRHWCYTHNIIGSRCRDEGFSSMYISIGAITVNRDGNPLFITTASTILADDNNRKSCSIIASSYGCDLLCSIVTESENDDYANPNPTKMVHGRFLYNGSYVEQALPNSLFQDKWVAQYPGVGSGITTHGKVLFPIYGGIKKNTQLFYELSKYGFFAHNKELECKNMTEEQIRDIKAAYLPSKTSGNLFAQGIIYCNISKLGDCNVAVLNTSTTMMGAEGRLQMMGEYVYYYQRSSSWWPVGIVYKKSLAELMNGINMEVLSFEPIPLSKFPRPTWTAGLCQKPSICPDVCVTGVYTDLFSVTIGSTTDKDTYFGVYLDSATERKDPWVAAADQYEWRNRVRLFESTTEAAYTTSTCFKNTVNNRVFCVSIVELRENLLGDWKIVPLLFQIGVSQGPPPK

SEQ ID NO: 131 - protein, 1046 aa, Beilong virus
  MISC_FEATURE: attachment glycoprotein
MSQLAAHNLAMSNFYGTHQGDLSGSQKGEEQQVQGVIRYVSMIVGLLSLFTIIALNVTNIIYMTESGGTMQSIKTAQGSIDGSMREISGVIMEDVKPKTDLINSMVSYNIPAQLSMIHQIIKNDVLKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDLNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFTGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVSIGRNLTKEGDLTMSAPEDPGSNTFPGGHIPGNGLFDAGYYTVEYPKEWKQTTPKPSEGGNIIDKNKTPVIPSRDNPTSDSSIPHRESIEPVRPTREVLKSSDYVTIVSTDSGSGSGDFATGVPWTGVSPKAPQNGINLPGTELPHPTVLDRINTPAPSDPKVSADSDHTRDTIDPTALSKPLNHDTTGDTDTRINTGTATYGFTPGREATSSGKLANDLTNSTSVPSEAHPSASTSEASKPEKNTDNRVTQDPTSGTAERPTTNAPVDGKHSTQLTDARPNTADPERTSQHSSSTTRDEVKPSLPSTTEASTHQRTEAATPPELVNNTLNPPSTQVRSVRSLMQDAIAQAWNFVRGVTP

SEQ ID NO: 132 - protein, 618 aa, Avian paramyxovirus UPO216
  MISC_FEATURE: hemagglutinin-neuraminidase protein
MERGISEVALANDRTEEKNTWRLIFRITVLVVSVITLGLTAASLVYSMNAAQPADFDGIIPAVQQVGTSLTNSIGGMQDVLDRTYKQVALESPLTLLNMESTIMNAITSLSYKINNGGNSSGCGAPIHDPEYIGGIGKELLIDDNVDVTSFYPSAFKEHLNFIPAPTTGAGCTRIPSFDLSATHYCYTHNVILSGCQDHSHSHQYIALGVLKLSDTGNVFFSTLRSINLDDTANRKSCSISATPLGCDILCSKVTETELEDYKSEEPTPMVHGRLSFDGTYSEKDLDVNNLFSDWTANYPSVGGGSYIGNRVWYAVYGGLKPGSNTDQSQRDKYVIYKRYNNTCPDPEDYQINKAKSSYTPSYFGSKRVQQAILSIAVSPTLGSDPVLTPLSNDVVLMGAEGRVMHIGGYTYLYQRGTSYYSPALLYPLNIQDKSATASSPYKFDAFTRPGSVPCQADARCPQSCVTGVYTDPYPLIFAKDHSIRGVYGMMLNDVTARLNPIAAVFSNISRSQITRVSSSSTKAAYTTSTCFKVIKTNRIYCMSIAEISNTLFGEFRIVPLLVEILSNGGNTARSAGGTPVKESPKGWSDAIAEPLFCTPTNVTRYNADIRRYAYSWP

SEQ ID NO: 133 - protein, 576 aa, Atlantic salmon paramyxovirus
  MISC_FEATURE: hemagglutinin-neuraminidase protein
MPPAPSPVHDPSSFYGSSLFNEDTASRKGTSEEIHLLGIRWNTVLIVLGLILAIIGIGIGASSFSASGITGNTTKEIRLIVEEMSYGLVRISDSVRQEISPKVTLLQNAVLSSIPALVTTETNTIINAVKNHCNSPPTPPPPTEAPLKKHETGMAPLDPTTYWTCTSGTPRFYSSPNATFIPGPSPLPHTATPGGCVRIPSMHIGSEIYAYTSNLIASGCQDIGKSYQNVQIGVLDRTPEGNPEMSPMLSHTFPINDNRKSCSIVTLKRAAYIYCSQPKVTEFVDYQTPGIEPMSLDHINANGTTKTWIYSPTEVVTDVPYASMYPSVGSGVVIDGKLVFLVYGGLLNGIQVPAMCLSPECPGIDQAACNASQYNQYLSGRQVVNGIATVDLMNGQKPHISVETISPSKNWFGAEGRLVYMGGRLYIYIRSTGWHSPIQIGVIYTMNPLAITWVTNTVLSRPGSAGCDWNNRCPKACLSGVYTDAYPISPDYNHLATMILHSTSTRSNPVMVYSSPTNMVNYAQLTTTAQIAGYTTTSCFTDNEVGYCATALELTPGTLSSVQPILVMTKIPKECV

SEQ ID NO: 134 - protein, 5 aa, artificial sequence
  Caspase 2 protein sequence
VDVAD

What is claimed is:

1. A fusosome comprising:

a) a lipid bilayer comprising a re-targeted paramyxoviral fusogen, wherein the re-targeted paramyxoviral fusogen is covalently linked to a targeting moiety that binds to a target cell;

wherein the re-targeted paramyxoviral fusogen leads to preferential delivery of an exogenous agent to a target cell compared to a non-target cell;

wherein the target cell is a T cell; and wherein the exogenous agent is a chimeric antigen receptor (CAR); and b) a nucleic acid that comprises:

a payload gene encoding the exogenous agent; and (i) a positive target cell-specific regulatory element operatively linked to the payload gene, wherein the positive target cell-specific regulatory element increases expression of the payload gene in the target cell relative to a fusosome lacking the positive target cell-specific regulatory element; and (ii) a non-target cell-specific regulatory element (NTCSRE), that is a non-T cell specific regulatory element operatively linked to the payload gene, wherein the NTCSRE decreases expression of the payload gene in the non-target cell relative to a fusosome lacking the NTCSRE.

2. The fusosome of claim 1, wherein the target cell is a first type of T cell and the non-target cell is a second, different type of T cell or a non-T cell.

3. The fusosome of claim 1, wherein:

(i) the fusosome comprises a first exogenous or overexpressed immunosuppressive protein on the lipid bilayer; and/or (ii) a first immunostimulatory protein is absent or present at reduced levels in the fusosome.

4. The fusosome of claim 1, wherein the T cell is a CD4+ T cell, a CD8+ T cell, an alpha beta T cell, a gamma delta T cell, a naïve T cell, an effector T cell, a cytotoxic T cell, a regulatory T cell, a helper T cell, a memory T cell, a NKT cell, or a Mucosal associated invariant T (MAIT) cell.

5. The fusosome of claim 4, wherein the T cell is a regulatory T cell (Treg).

6. The fusosome of claim 1, wherein the re-targeted paramyxoviral fusogen is a viral envelope protein.

7. The fusosome of claim 6, wherein the re-targeted paramyxoviral fusogen comprises a sequence chosen from the group consisting of Nipah virus F and G proteins, measles virus F and H proteins, tupaia paramyxovirus F and H proteins, paramyxovirus F and G proteins or F and H proteins or F and HIN proteins, Hendra virus F and G proteins, Henipavirus F and G proteins, Morbilivirus F and H proteins, respirovirus F and HN protein, a Sendai virus F and HN protein, rubulavirus F and HIN proteins, avulavirus F and HN proteins, and any combination thereof.

8. The fusosome of claim 1, wherein the positive target cell-specific regulatory element comprises a T cell-specific promoter, a T cell-specific enhancer, a T cell-specific splice site, a T cell-specific site extending half-life of an RNA or protein, a T cell-specific mRNA nuclear export promoting site, a T cell-specific translational enhancing site, or a T cell-specific post-translational modification site.

9. The fusosome of claim 1, wherein the positive target cell-specific regulatory element comprises a T cell-specific promoter.

10. The fusosome of claim 9, wherein the T cell specific promoter is a CD38 promoter, a CD2 promoter, a Tyrosine-protein kinase Lck promoter, an ICOS promoter, a CD28 promoter, a TCF7 promoter, or a TCR VB 8.1 promoter.

11. The fusosome of claim 9, wherein the T cell specific promoter is a CD8 promoter or GZMB promoter.

12. The fusosome of claim 9, wherein the T cell specific promoter is a CD4 promoter.

13. The fusosome of claim 9, wherein the T cell-specific promoter is an IL2RA promoter, an LRRC32 promoter, a FOXP3 promoter, or an IKZF2 promoter.

14. The fusosome of claim 1, wherein the NTCSRE comprises a non-target cell-specific miRNA recognition sequence, non-target cell-specific protease recognition site, non-target cell-specific ubiquitin ligase site, non-target cell-specific transcriptional repression site, or non-target cell-specific epigenetic repression site.

15. The fusosome of claim 14, wherein the NTCSRE comprises a non-target cell-specific miRNA recognition sequence that is able to be bound by one or more of miR31, miR363, or miR29c.

16. The fusosome of claim 14, wherein the NTCSRE is situated or encoded within a transcribed region encoding the exogenous agent.

17. The fusosome of claim 1, wherein the nucleic acid comprises one or more insulator elements.

18. The fusosome of claim 17, wherein the nucleic acid comprises two insulator elements.

19. The fusosome of claim 18, wherein the two insulator elements comprise a first insulator element upstream of the payload gene and a second insulator element downstream of the payload gene.

20. The fusosome of claim 1, wherein the fusosome is a retroviral vector particle.

21. The fusosome of claim 1, wherein the fusosome is a lentiviral vector particle.

22. The fusosome of claim 1, wherein the CAR targets an antigen that is a B cell antigen, an autoantigen, an antigen characteristic of a neoplastic cell, or an antigen characteristic of an infectious disease.

23. The fusosome of claim 1, wherein the exogenous agent is a chimeric autoantibody receptor (CAAR).

24. The fusosome of claim 1, wherein the targeting moiety is an antibody, an antigen-binding portion of an antibody, or a receptor ligand.

25. A pharmaceutical composition comprising the fusosome of claim 1, and a pharmaceutically acceptable carrier, diluent, or excipient.

26. A method of delivering a chimeric antigen receptor (CAR) to a subject comprising administering to the subject the fusosome of claim 1 or the pharmaceutical composition of claim 25, thereby delivering the CAR to the subject.

27. The method of claim 26, wherein the subject is a human subject.

28. The method of claim 26, wherein the exogenous agent is delivered to a T cell of the subject.

29. A method of modulating a function in a T cell, the method comprising contacting the T cell with the fusosome of claim 1 or the pharmaceutical composition of claim 25, thereby modulating the function in the T cell.

30. The method of claim 29, wherein the T cell is a CD4+ T cell, a CD8+ T cell, an alpha beta T cell, a gamma delta T cell, a naïve T cell, an effector T cell, a cytotoxic T cell (e.g., a CD8+ cytotoxic T cell), a regulatory T cell (e.g., a thymus-derived regulatory T cell, a peripherally derived regulatory T cell, a CD4+Foxp3+ regulatory T cell, or a CD4+FoxP3-type 1 regulatory T (Tr1) cell), a helper T cell (e.g., a CD4+ helper T cell, a Th1 cell, a Th2 cell, a Th3 cell, a Th9 cell, a Th17 cell, a Th22 cell, or a T follicular helper (Tfh) cell), a memory T cell (e.g., a stem cell memory T cell, a central memory T cell, or an effector memory T cell), a NKT cell, or a Mucosal associated invariant T (MAIT) cell.

31. The method of claim 29, wherein the T cell is present in a subject.

32. The method of claim 31, wherein the T cell is a regulatory T cell (Treg).

33. A method of treating a disease or disorder in a subject comprising administering to the subject the fusosome of claim 1 or the pharmaceutical composition of claim 25, thereby treating the disease or disorder in the subject.

34. The method of claim 33, wherein the disease or disorder is a disease or disorder able to be treated by the payload gene encoding the exogenous agent.

35. The method of claim 33, wherein the disease or disorder is selected from acute GvHD, alopecia areata, autoimmune uveitis, celiac disease, chronic GvHD, Crohn's disease, endometriosis, eosinophilic esophagitis, Grave's disease, Hashimoto's thyroiditis, multiple sclerosis, myasthenia gravis, pemphigoid, pemphigus, rheumatoid arthritis, solid organ transplant, systemic lupus erythmatosus, type 1 diabetes, and ulcerative colitis.

36. The method of claim 33, wherein the disease or disorder is a cancer, an autoimmune disease, an infectious disease, a metabolic disease, a neurodegenerative disease, or a genetic disease.

37. A method of making the fusosome of claim 1, comprising:

a) providing a cell that comprises the nucleic acid and the re-targeted paramyxoviral fusogen;

b) culturing the cell under conditions that allow for production of the fusosome, and c) separating, enriching, or purifying the fusosome from the cell, thereby making the fusosome.

38. A fusosome comprising:

a) a lipid bilayer comprising a re-targeted paramyxoviral fusogen, wherein the re-targeted paramyxoviral fusogen is covalently linked to a targeting moiety that binds to a target cell;

wherein the re-targeted paramyxoviral fusogen leads to preferential delivery of an exogenous agent to a target cell compared to a non-target cell;

wherein the target cell is a T cell; and wherein the exogenous agent is a chimeric antigen receptor (CAR); and b) a nucleic acid that comprises:

(i) a payload gene encoding the exogenous agent; and (ii) a promoter chosen from an IL2RA, LRRC32, FOXP3, and IKZF2 promoter, and wherein the promoter is operatively linked to the payload gene.

39. A fusosome comprising:

a) a lipid bilayer comprising a re-targeted paramyxoviral fusogen, wherein the re-targeted paramyxoviral fusogen is covalently linked to a targeting moiety that binds to a target cell, wherein the re-targeted paramyxoviral fusogen leads to preferential delivery of an exogenous agent to a target cell compared to a non-target cell;

wherein the target cell is a T cell; and wherein the exogenous agent is a chimeric antigen receptor (CAR); and b) a nucleic acid that comprises:

(i) a payload gene encoding the exogenous agent; and (ii) a non-target cell-specific regulatory element (NTCSRE), that is a non-T cell specific regulatory element operatively linked to the payload gene, wherein the NTCSRE decreases expression of the payload gene in the non-target cell relative to a fusosome lacking the NTCSRE.

40. A fusosome, wherein:

a) the fusosome comprises a lipid bilayer comprising a re-targeted paramyxoviral fusogen, wherein the re-targeted paramyxoviral fusogen is covalently linked to a targeting moiety that binds to a target cell;

wherein the re-targeted paramyxoviral fusogen leads to preferential delivery of an exogenous agent to a target cell compared to a non-target cell;

wherein the target cell is a T cell;

wherein the exogenous agent is a chimeric antigen receptor (CAR);

b) the fusosome comprises a nucleic acid that comprises a payload gene encoding the exogenous agent; and c) one or both of:

(i) the fusosome comprises a first exogenous or overexpressed immunosuppressive protein on the lipid bilayer; or (ii) a first immunostimulatory protein is absent or present at reduced levels in the fusosome compared to a fusosome generated from an unmodified source cell.

41. The fusosome of claim 40, wherein:

the nucleic acid further comprises a positive target cell-specific regulatory element operatively linked to the payload gene, wherein the positive target cell-specific regulatory element increases expression of the payload gene in the target cell relative to a fusosome lacking the positive target cell-specific regulatory element; and/or the nucleic acid further comprises a non-target cell-specific regulatory element (NTCSRE) that is a non-T-cell specific regulatory element operatively linked to the payload gene, wherein the non-T-cell specific regulatory element decreases expression of the payload gene in the non-target cell relative to a fusosome lacking the NTCSRE.

42. The fusosome of claim 40, wherein the immunosuppressive protein is a complement regulatory protein or CD47.

43. The fusosome of claim 40, wherein the immunostimulatory protein is an MHC I or MHC II protein.

* * * * *